United States Patent
Mallonee et al.

(10) Patent No.: US 9,376,727 B2
(45) Date of Patent: Jun. 28, 2016

(54) FAST RESULTS HYBRID CAPTURE ASSAY AND ASSOCIATED STRATEGICALLY TRUNCATED PROBES

(75) Inventors: Richard Mallonee, Baltimore, MD (US); Peter Qiu, Gaithersburg, MD (US)

(73) Assignee: QIAGEN GAITHERSBURG, INC., Gaithersburg, MD (US)

( * ) Notice: Subject to any disclaimer, the term of this patent is extended or adjusted under 35 U.S.C. 154(b) by 641 days.

(21) Appl. No.: 13/114,344

(22) Filed: May 24, 2011

(65) Prior Publication Data

US 2012/0004128 A1 Jan. 5, 2012

Related U.S. Application Data

(60) Provisional application No. 61/347,941, filed on May 25, 2010.

(51) Int. Cl.
*C12Q 1/68* (2006.01)
*C07H 21/02* (2006.01)
*C07H 21/04* (2006.01)
*C12Q 1/70* (2006.01)

(52) U.S. Cl.
CPC ..................................... *C12Q 1/708* (2013.01)

(58) Field of Classification Search
None
See application file for complete search history.

(56) References Cited

U.S. PATENT DOCUMENTS

| | | |
|---|---|---|
| 4,486,536 A | 12/1984 | Baker et al. |
| 4,486,539 A | 12/1984 | Ranki et al. |
| 4,563,417 A | 1/1986 | Alabrella et al. |
| 4,563,419 A | 1/1986 | Ranki et al. |
| 4,689,294 A | 8/1987 | Boguslawski et al. |
| 4,731,325 A | 3/1988 | Palva et al. |
| 4,732,847 A | 3/1988 | Stuart et al. |
| 4,743,535 A | 5/1988 | Carrico |
| 4,751,177 A | 6/1988 | Stabinsky et al. |
| 4,851,330 A | 7/1989 | Kohne et al. |
| 4,865,980 A | 9/1989 | Stuart et al. |
| 4,868,105 A | 9/1989 | Urdea et al. |
| 4,894,325 A | 1/1990 | Englehardt et al. |
| 5,082,830 A | 1/1992 | Brakel et al. |
| 5,106,727 A | 4/1992 | Hartley et al. |
| 5,142,032 A | 8/1992 | Grimmel et al. |
| 5,182,377 A | 1/1993 | Manos et al. |
| 5,187,090 A | 2/1993 | De Villiers et al. |
| 5,200,313 A | 4/1993 | Carrico |
| 5,283,171 A | 2/1994 | Manos et al. |
| 5,288,611 A | 2/1994 | Kohne et al. |
| 5,342,930 A | 8/1994 | Orth et al. |
| 5,346,811 A | 9/1994 | Galindo-Castro et al. |
| 5,364,758 A | 11/1994 | Meijer et al. |
| 5,374,524 A | 12/1994 | Miller et al. |
| 5,382,509 A | 1/1995 | Grimmel et al. |
| 5,411,857 A | 5/1995 | Beaudenon et al. |
| 5,424,413 A | 6/1995 | Hogan et al. |
| 5,427,930 A | 6/1995 | Birkenmeyer et al. |
| 5,437,951 A | 8/1995 | Lowy et al. |
| 5,437,977 A | 8/1995 | Segev |
| 5,447,839 A | 9/1995 | Manos et al. |
| 5,474,895 A | 12/1995 | Ishii et al. |
| 5,484,699 A | 1/1996 | Bouma et al. |
| 5,501,947 A | 3/1996 | Emery et al. |
| 5,506,105 A | 4/1996 | Haydock |
| 5,527,898 A | 6/1996 | Bauer et al. |
| 5,534,406 A | 7/1996 | Liang et al. |
| 5,534,439 A | 7/1996 | Orth et al. |
| 5,545,806 A | 8/1996 | Lonberg et al. |
| 5,545,807 A | 8/1996 | Surani et al. |
| 5,554,538 A | 9/1996 | Cole et al. |
| 5,556,748 A | 9/1996 | Douglas |
| 5,580,970 A | 12/1996 | Hendricks et al. |
| 5,582,988 A | 12/1996 | Backus et al. |
| 5,591,574 A | 1/1997 | Orth et al. |
| 5,595,884 A | 1/1997 | Androphy et al. |
| 5,622,822 A | 4/1997 | Ekeze et al. |
| 5,623,049 A | 4/1997 | Lobberding et al. |
| 5,629,156 A | 5/1997 | Shah et al. |
| 5,635,352 A | 6/1997 | Urdea et al. |
| 5,639,871 A | 6/1997 | Bauer et al. |
| 5,643,715 A | 7/1997 | Lancaster |
| 5,656,423 A * | 8/1997 | Orth et al. .................... 435/5 |
| 5,656,731 A | 8/1997 | Urdea |
| 5,679,509 A | 10/1997 | Wheeler et al. |
| 5,681,897 A | 10/1997 | Silvis et al. |
| 5,695,926 A | 12/1997 | Cros et al. |
| 5,705,627 A | 1/1998 | Manos et al. |

(Continued)

FOREIGN PATENT DOCUMENTS

| | | |
|---|---|---|
| CN | 1690223 A | 11/2005 |
| CN | 101177701 A | 5/2008 |
| EP | 0079139 | 5/1983 |
| EP | 0 163 220 | 12/1985 |
| EP | 1 167 366 | 1/1986 |
| EP | 0184017 | 6/1986 |
| EP | 0 281 927 | 9/1988 |
| EP | 0 288 737 | 11/1988 |

(Continued)

OTHER PUBLICATIONS

Supplementary European Search Report of PCT/US2006/060603, dated Jul. 7, 2010 (8 pages).

(Continued)

*Primary Examiner* — Jehanne Sitton

(74) *Attorney, Agent, or Firm* — McBee Moore Woodward Vanik IP, LLC.

(57) ABSTRACT

Strategically truncated probes specific for high-risk HPV nucleic acids, and methods for making and using the same, are disclosed herein. The disclosed probes, and methods of use thereof, permit fast and reliable detection of human papillomavirus in clinical samples without significant cross-reaction.

13 Claims, 88 Drawing Sheets

(56) References Cited

U.S. PATENT DOCUMENTS

| | | |
|---|---|---|
| 5,712,092 A | 1/1998 | Orth et al. |
| 5,719,054 A | 2/1998 | Boursnell et al. |
| 5,728,531 A | 3/1998 | Yamada et al. |
| 5,731,153 A | 3/1998 | Lucas et al. |
| 5,750,334 A | 5/1998 | Cerutti et al. |
| 5,750,338 A | 5/1998 | Collins et al. |
| 5,756,282 A | 5/1998 | Crooke et al. |
| 5,759,773 A | 6/1998 | Tyagi et al. |
| 5,783,412 A | 7/1998 | Morris et al. |
| 5,786,183 A | 7/1998 | Ryder et al. |
| 5,800,984 A | 9/1998 | Vary |
| 5,811,232 A | 9/1998 | Crooke et al. |
| 5,814,448 A | 9/1998 | Silverstein et al. |
| 5,820,870 A | 10/1998 | Joyce et al. |
| 5,824,466 A | 10/1998 | Orth et al. |
| 5,840,306 A | 11/1998 | Hofmann et al. |
| 5,853,993 A | 12/1998 | Dellinger et al. |
| 5,863,717 A | 1/1999 | Lancaster et al. |
| 5,874,213 A | 2/1999 | Cummins et al. |
| 5,876,922 A | 3/1999 | Orth et al. |
| 5,888,724 A | 3/1999 | Silverstein et al. |
| 5,888,736 A | 3/1999 | Lacroix et al. |
| 5,952,487 A | 9/1999 | Philipp et al. |
| 5,958,674 A | 9/1999 | Beaudenon et al. |
| 5,981,171 A | 11/1999 | Kuhns |
| 5,981,173 A | 11/1999 | Orth et al. |
| 5,993,821 A | 11/1999 | Frazer et al. |
| 6,010,895 A | 1/2000 | Deacon et al. |
| 6,013,258 A | 1/2000 | Urban et al. |
| 6,013,262 A | 1/2000 | Frazer et al. |
| 6,025,163 A | 2/2000 | Shamanin et al. |
| 6,027,891 A | 2/2000 | Von Knebel-Doberitz et al. |
| 6,045,993 A | 4/2000 | Mahony et al. |
| 6,045,995 A | 4/2000 | Cummins et al. |
| 6,057,099 A | 5/2000 | Nathan et al. |
| 6,110,676 A | 8/2000 | Coull et al. |
| 6,110,682 A | 8/2000 | Dellinger et al. |
| 6,110,687 A | 8/2000 | Nilsen |
| 6,127,164 A | 10/2000 | De Villiers et al. |
| 6,159,729 A | 12/2000 | Hofmann et al. |
| 6,174,532 B1 | 1/2001 | Campo et al. |
| 6,174,870 B1 | 1/2001 | Crooke et al. |
| 6,207,385 B1 | 3/2001 | Stanley |
| 6,214,555 B1 | 4/2001 | Leushner et al. |
| 6,218,104 B1 | 4/2001 | Morris et al. |
| 6,218,105 B1 | 4/2001 | Hall et al. |
| 6,228,577 B1 | 5/2001 | Mahony et al. |
| 6,228,578 B1 | 5/2001 | Impraim et al. |
| 6,228,580 B1 | 5/2001 | Blumenfeld et al. |
| 6,235,523 B1 | 5/2001 | Gajewczyk et al. |
| 6,265,154 B1 | 7/2001 | Kroeger et al. |
| 6,268,128 B1 | 7/2001 | Collins et al. |
| 6,277,570 B1 | 8/2001 | Wood et al. |
| 6,277,579 B1 | 8/2001 | Lazar et al. |
| 6,284,532 B1 | 9/2001 | Brown et al. |
| 6,290,965 B1 | 9/2001 | Jansen et al. |
| 6,322,795 B1 | 11/2001 | Shamanin et al. |
| 6,329,152 B1 | 12/2001 | Patterson |
| 6,331,423 B1 | 12/2001 | Guegler et al. |
| 6,352,696 B1 | 3/2002 | Hallek et al. |
| 6,352,825 B1 | 3/2002 | Meijer et al. |
| 6,355,424 B1 | 3/2002 | Lorincz et al. |
| 6,388,065 B1 | 5/2002 | Duerst et al. |
| 6,395,512 B1 | 5/2002 | Shamanin et al. |
| 6,413,522 B1 | 7/2002 | De Villiers-Zur Hausen et al. |
| 6,420,106 B1 | 7/2002 | Gyllensten et al. |
| 6,458,940 B2 | 10/2002 | Roberts et al. |
| 6,482,588 B1 | 11/2002 | Van Doorn et al. |
| 6,488,935 B1 | 12/2002 | De Villiers Zur Hausen et al. |
| 6,495,676 B1 | 12/2002 | Wood et al. |
| 6,503,704 B1 | 1/2003 | Mahony et al. |
| 6,509,149 B2 | 1/2003 | Roberts et al. |
| 6,511,805 B1 | 1/2003 | Gocke et al. |
| 6,544,732 B1 | 4/2003 | Chee et al. |
| 6,582,908 B2 * | 6/2003 | Fodor et al. .............. 506/9 |
| 6,583,278 B1 | 6/2003 | Carter |
| 6,589,532 B1 | 7/2003 | De Villiers-Zur Hausen et al. |
| 6,610,303 B1 | 8/2003 | De-Villiers-zur Hausen et al. |
| 6,613,557 B1 | 9/2003 | Frazer et al. |
| 6,649,167 B2 | 11/2003 | Hallek et al. |
| 6,670,150 B1 | 12/2003 | Gong et al. |
| 6,737,239 B2 | 5/2004 | Wood et al. |
| 6,828,098 B2 | 12/2004 | Langmore et al. |
| 6,852,487 B1 | 2/2005 | Barany et al. |
| 6,884,605 B2 | 4/2005 | Hermonat et al. |
| 6,902,899 B2 | 6/2005 | Iftner |
| 6,936,443 B2 | 8/2005 | Cohenford et al. |
| 6,951,722 B2 | 10/2005 | Mukai et al. |
| 6,977,148 B2 | 12/2005 | Dean et al. |
| 7,001,995 B1 | 2/2006 | Neeper et al. |
| 7,033,758 B2 | 4/2006 | Kenny et al. |
| 7,041,500 B2 | 5/2006 | Robinson |
| 7,063,963 B2 | 6/2006 | Cole et al. |
| 7,138,505 B1 | 11/2006 | Kuo |
| 7,169,585 B2 | 1/2007 | Frazer et al. |
| 7,183,053 B2 | 2/2007 | Gocke et al. |
| 7,250,170 B2 | 7/2007 | Bryan et al. |
| 7,276,243 B2 | 10/2007 | Jansen et al. |
| 7,291,455 B2 | 11/2007 | Lorincz et al. |
| 7,294,488 B2 | 11/2007 | Jeney et al. |
| 7,301,015 B2 | 11/2007 | Yoon et al. |
| 7,354,719 B2 | 4/2008 | Norman et al. |
| 7,355,034 B2 | 4/2008 | Gordon et al. |
| 7,361,356 B2 | 4/2008 | Lowy et al. |
| 7,378,099 B2 | 5/2008 | Cassetti et al. |
| 7,393,633 B1 | 7/2008 | Park et al. |
| 7,407,807 B2 | 8/2008 | Varsani et al. |
| 7,423,138 B2 | 9/2008 | Howley et al. |
| 7,468,248 B2 | 12/2008 | DeNise et al. |
| 7,470,512 B2 | 12/2008 | Gordon et al. |
| 7,482,142 B1 | 1/2009 | Kornegay et al. |
| 7,498,036 B2 | 3/2009 | Bryan et al. |
| 7,510,834 B2 | 3/2009 | Inoko et al. |
| 7,517,645 B2 | 4/2009 | Sokolova et al. |
| 7,524,631 B2 | 4/2009 | Patterson |
| 7,527,948 B2 | 5/2009 | Hudson et al. |
| 7,531,305 B2 | 5/2009 | Thunnissen et al. |
| 7,553,623 B2 | 6/2009 | Karlsen |
| 7,569,344 B2 | 8/2009 | Light et al. |
| 7,601,497 B2 | 10/2009 | Nazarenko et al. |
| 7,670,774 B2 | 3/2010 | Moon et al. |
| 7,682,792 B2 | 3/2010 | Norman et al. |
| 7,687,232 B2 | 3/2010 | Gyllensten et al. |
| 7,700,103 B2 | 4/2010 | Bryan et al. |
| 7,704,965 B2 | 4/2010 | Clawson et al. |
| 7,812,144 B2 | 10/2010 | Karlsen |
| 8,012,944 B2 | 9/2011 | LaCasse et al. |
| 2001/0055766 A1 | 12/2001 | Aristarkhov et al. |
| 2002/0012936 A1 | 1/2002 | Lorincz et al. |
| 2003/0096232 A1 | 5/2003 | Kris et al. |
| 2003/0108897 A1 | 6/2003 | Drmanac |
| 2003/0175765 A1 | 9/2003 | Kessler et al. |
| 2003/0175789 A1 | 9/2003 | Weininger et al. |
| 2004/0180362 A1 | 9/2004 | Lazar et al. |
| 2004/0214302 A1 | 10/2004 | Anthony et al. |
| 2005/0009063 A1 | 1/2005 | Xia et al. |
| 2005/0026976 A1 | 2/2005 | Curtin et al. |
| 2005/0032038 A1 | 2/2005 | Fisher et al. |
| 2005/0032105 A1 | 2/2005 | Bair et al. |
| 2005/0119217 A1 | 6/2005 | LaCasse et al. |
| 2005/0147996 A1 | 7/2005 | Sorge |
| 2006/0051809 A1 | 3/2006 | Nazarenko et al. |
| 2006/0160069 A1 | 7/2006 | Chau et al. |
| 2006/0160188 A1 | 7/2006 | Kurnit et al. |
| 2006/0240449 A1 | 10/2006 | McGlennen et al. |
| 2006/0275784 A1 | 12/2006 | Light |
| 2007/0109898 A1 | 5/2007 | Kasai |
| 2007/0154884 A1 | 7/2007 | Lorincz |
| 2007/0292899 A1 | 12/2007 | Lovell et al. |
| 2009/0286687 A1 | 11/2009 | Dressman et al. |
| 2010/0081124 A1 | 4/2010 | Abravaya et al. |
| 2010/0105060 A1 | 4/2010 | Eder et al. |

(56) References Cited

U.S. PATENT DOCUMENTS

| | | | |
|---|---|---|---|
| 2010/0311039 | A1 | 12/2010 | Lowe et al. |
| 2011/0009277 | A1 | 1/2011 | Devos et al. |
| 2014/0087449 | A1 | 3/2014 | Ballhause et al. |

FOREIGN PATENT DOCUMENTS

| | | |
|---|---|---|
| EP | 0333465 | 9/1989 |
| EP | 0 336 454 | 11/1992 |
| EP | 0 144 914 | 6/1995 |
| EP | 0 415 978 | 3/1996 |
| EP | 0 703 296 | 3/1996 |
| EP | 1 806 410 A2 | 7/2007 |
| EP | 2 184 368 A1 | 5/2010 |
| JP | H07505759 A | 6/1995 |
| JP | T H-07-505759 A | 6/1995 |
| JP | H08505770 A | 6/1996 |
| JP | 200400508019 A | 3/2004 |
| JP | T-2007-509861 A | 4/2007 |
| JP | 2009 106220 | 5/2009 |
| WO | 84/02721 | 7/1984 |
| WO | 8607387 | 12/1986 |
| WO | 88/03957 | 6/1988 |
| WO | 91/08312 | 6/1991 |
| WO | 93/10263 | 5/1993 |
| WO | 93/10263 A1 | 5/1993 |
| WO | 94/16108 | 7/1994 |
| WO | 94/16108 A1 | 7/1994 |
| WO | 95/16055 | 6/1995 |
| WO | 95/17430 | 6/1995 |
| WO | 96/40992 | 5/1996 |
| WO | 97/05277 | 2/1997 |
| WO | 97/10364 | 3/1997 |
| WO | 97/31256 | 8/1997 |
| WO | 98/18488 | 5/1998 |
| WO | 98/22620 | 5/1998 |
| WO | 99/02488 | 1/1999 |
| WO | 99/32654 | 7/1999 |
| WO | 99/36571 | 7/1999 |
| WO | 99/40224 | 8/1999 |
| WO | 99/49224 | 9/1999 |
| WO | 99/50459 | 10/1999 |
| WO | 00/60116 | 10/2000 |
| WO | 01/36681 | 5/2001 |
| WO | 01/96608 | 12/2001 |
| WO | 0196608 | 12/2001 |
| WO | 02066993 A1 | 8/2002 |
| WO | 2004/087950 | 10/2004 |
| WO | 2005042030 A1 | 5/2005 |
| WO | 2005/088311 A1 | 9/2005 |
| WO | 2006039563 A2 | 4/2006 |
| WO | 2006/124771 A2 | 11/2006 |
| WO | 2007/056723 | 5/2007 |
| WO | 2007/130519 A2 | 11/2007 |
| WO | 2007134252 A1 | 11/2007 |
| WO | 2008/036061 | 3/2008 |
| WO | 2008/139938 A1 | 11/2008 |
| WO | 2008149237 A2 | 12/2008 |
| WO | 2009/057993 A1 | 5/2009 |
| WO | 2009/123996 | 10/2009 |
| WO | 2010/004251 A1 | 1/2010 |
| WO | 2010/028382 | 3/2010 |
| WO | 2010/127228 A1 | 11/2010 |

OTHER PUBLICATIONS

Lowe, et al., "A computer program for selection of oligonucleotide primers for polymerase chain reactions", Nucleic Acid Res., vol. 18, No. 7, pp. 1757-1761 (1990).

International Search Report and Written Opinion of PCT/US2010/022264 dated Jun. 7, 2010 (19 pages).

Cohenford et al., "C-195, Rapid Detection of Chlamydia trachomatis from Specimens Collected from the ThinPrep Pap Test using Molecular Beacons and the Roche LightCycler," Abstracts of the General Meeting of the American Society for Microbiology, The Society, Washington, DC. (Jan. 1, 2001), p. 195, vol. 101. XP001098006.

Gentech Diagnostics: "Chlamydia DNA Test Kit," (Jun. 6. 2008), XP002578832, Retrieved from the internet: URL: http://www.gentechin.com/chlamydiatestkit.htm.

Taha et al., "Universal Collection Medium (UCM) is as suitable as the Standard Transport Medium (STM) for Hybrid Capture II (HC-2) assay," Journal of Clinical Virology, (May 1, 2006), pp. 32-35, vol. 36, No. 1, XP005367693.

Darwin et al., "Comparison of Digene Hybrid Capture 2 and Conventional Culture for Detection of Chlamydia trachomatis and Neisseria gonorrhoeae in Cervical Specimens," Journal of Clinical Microbiology, (Feb. 2002), pp. 641-644, vol. 40, No. 2, XP002578833.

Nazarenko et al., "A novel method of HPV genotyping using Hybrid Capture sample preparation method combined with GP5+/6+ PCR and multiplex detection on Luminex XMAP," Journal of Clinical Virology, (Dec. 1. 2008), pp. 76-81, vol. 154, No. 1-2, XP025680302.

International Search Report and Written Opinion of PCT/US10/33145, dated Aug. 5, 2010 (9 pages).

A Lorincz, "Hybrid Capture," Clin. Chem., (Jun. 1998), pp. 1363, vol. 44, No. 6.

Vernick et al., "The HPV DNA virus hybrid capture assay: What is it—and Where do we go from here?" MLO Med. Lab. Obs., (Mar. 2003). pp. 8-10, 13, vol. 35, No. 3.

International Search Report and Written Opinion of PCT/US2010/048714, dated Dec. 10, 2010 (14 pages).

International Preliminary Report on Patentability and Written Opinion of PCT/US2009/041033, dated Oct. 19, 2010 03 pages).

International Search Report and Written Opinion of PCT/US2010/047769, dated Nov. 9, 2010 (11 pages).

Pachowics, et al., "Sequence specific large volume sample prep solution utilizing Hybrid Capture technology," 41st Annual Oak Ridge Conference; Baltimore, MD, Apr. 16, 2009; retrieved from the Internet: http://www.aacc.org/events/meeting_proceeding/2009/Documents/OakRidge09AllPosters.pdf.

Keegan et al., "Comparison of HPV detection technologies: Hybrid capture 2, PreTect HPV-Proofer and analysis of HPV DNA viral load in HPV16, HPV18 and HPV33 E6/E7 mRNA positive specimens," Journal of Virological Methods, Jan. 1, 2009, pp. 61-66, vol. 155, No. 1, Elsevier BV, XP025799776.

Murphy et al., "Isolation of RNA from cell lines and cervical cytology specimens stored in BD SurePath (TM) preservative fluid and downstream detection of housekeeping gene and HPV E6 expression using real time RT-PCR," Journal of Virological Methods, Mar. 1, 2009, pp. 138-144, vol. 156, No. 1-2, Elsevier BV, XP025941323.

Powell et al., "Recovery of human papillomavirus nucleic acids from liquid-based cytology media," Journal of Virological Methods, Oct. 1, 2006, pp. 58-62, vol. 137, No. 1, Elsevier BV, XP005600251.

Nindl et al., "Human Papillomavirus Distribution in Cervical Tissues of Different Morphology as Determined by Hybrid Capture Assay and PCR," International Journal of Gynecological Pathology, Jan. 1, 1997, pp. 197-204, vol. 16, No. 3, Lippincott-Raven Publishers, XP008011933.

Hernandez-Hernandez et al., "Association between high-tisk human papillomavirus DNA load and precursor lesions of cervical cancer in Mexican women," Gynecologic Oncology, Aug. 2003, pp. 310-317, vol. 90, No. 2, Elsevier Science, XP002603500.

Tsai et al., "Association between Quantitative High-Risk Human Papillomavirus DNA Load and Cervical Intraepithelial Neoplasm Risk," Cancer Epidemiology, Biomarkers & Prevention: American Association for Cancer Research, Nov. 2005, pp. 2544-2549, vol. 14, No. 11 pt 1, XP002603501.

Moodley et al., "Human papillornavirus prevalence, viral load and pre-cancerous lesions of the cervix in women initiating highly active antiretroviral therapy in South Africa: a cross-sectional study," BMC Cancer, Aug. 7, 2009, pp. 1-8, vol. 9, No. 275, Biomed Central Ltd, XP002603502.

Ronco et al., "HPV triage for low grade (L-SIL) cytology is appropriate for women over 35 in mass cervical cancer screening using liquid based cytology," European Journal of Cancer, Feb. 1, 2007, pp, 476480, vol. 43, No. 3, Pergamon Press, Oxford GB, XP005868775.

(56) References Cited

OTHER PUBLICATIONS

Lowe et al.: "HPV Genotype Detection Using Hybrid Capture Sample Preparation Combined with Whole Genome Amplification and Multiplex Detection with Luminex XMAP," Journal of Molecular Diagnostics; Nov. 6, 2010; pp. 847-853; vol. 12; No. 6; American Society for Investigative Pathology.
Partial European Search Report of EP10185824; mailed Feb. 16, 2011 (8 pages).
Scott et al., "Detection of herpes simplex virus type 1 shedding in the oral cavity by polymerase chain reaction and enzyme-linked immunosorbent assay at the prodromal stage of recrudescent herpes labialis," Journal of Oral Pathology & Medicine; Aug. 1997; pp. 305-309; vol. 26; No. 7; XP009143938.
Ryncarz et al., "Development of a High-Throughput Quantitative Assay for Detecting Herpes Simplex Virus DNA in Clinical Samples," Journal of Clinical Microbiology; Jun. 1999; pp. 1941-1947; vol. 37, No. 6; American Society for Microbiology.
International Search Report and Written Opinion of PCT/US2011/22887, dated Jun. 1, 2011.
International Preliminary Report on Patentability and Written Opinion of PCT/US2009/062061, dated May 12, 2011.
International Preliminary Report on Patentability and Written Opinion of PCT/US2009/062041, dated May 12, 2011.
GenBank Submission FJ429103. 2009 [Retrieved from the Internet May 20, 2011: <URL:http://www.ncbi.nlm.nih.gov/nuccore/FJ429103.1>]; in entirety.
Mittendorf T, et al., "HPV-DNA-Diagnostik zur Zervixkarzinomfrüherkennung; Deutsche Agentur für HTA des Deutschen Instituts für Medizinische Dokumentation und Information," 1. Auflage 2007.
Nanda K, et al., "Accuracy of the Papanicolaou Test in Screening for and Follow-up of Cervical Cytologic Abnormalities: A Systematic Review, Annals of Internal Medicine," 132(10):810-819, May 16, 2000.
Davey DD, et al., "Introduction and Commentary, Strategic Science Symposium, Human Papillomavirus Testing—Are you ready for a new era in cervical cancer screening?," Arch Pathol Lab Med, 127: 927-929, Aug. 2003.
Malloy C, et al., "HPV DNA Testing: Technical and Programmatic Issues for Cervical Cancer Prevention in Low-Resource Settings," Path, Dec. 2000.
Stacey SN, et al., "Translation of the Human Papillomavirus Type 16 E7 Oncoprotein from Bicisironic mRNA is independent of Splicing Events within the E6 Open Reading Frame," Journal of Virology. 69(11):7023-7031, Nov. 1995.
Hsu E, et al., Quantification of HPV-16 E6-E7 Transcription in Cervical Intraepithelial Neoplasia by Reverse Transcriptase Polymerase Chain Reaction, Int. J. Cancer: 55, 397-401 (1993).
Bohm S. et al., "The Predominant mRNA Class in HPV16-Infected Genital Neoplasias does not Encode the E6 or the E7 Protein," Int. J. Cancer: 55, 791-798 (1993).
Middleton, K, et al., "Organization of Human Papillomavirus Productive Cycle during Neoptastic Progression Provides a Basis for Selection of Diagnostic markers." Journal of Virology, Oct. 2003, pp. 10186-10201.
Kleter et al., "Development and clinical evaluation of a highly sensitive PCT-reverse hybridization line probe assay for detection and identification of anogenital human papillomafirus," In: Journal of clinical Micorbiology, Aug. 1999, vol. 37(8), pp. 2508-2517, see the whole document.
GenBank Accession No. AB027021, "Human papillomavirus type 82 DNA, complete genome.", Jun. 22, 2000. See http://www.ncbi.nlm.nih.gov/nuccore/6970427.
GenBank Accession No. X67161, "Human papillomavirus type L1 gene for major capsid protein.", Apr. 18, 2005. See http://www.ncbi.nlm.nih.gov/nuccore/1197494.
Park, JS, et al., "Physical Status and Expression of HPV Genes Cervical Cancers," Gynec. Oncol. 95 (1997), pp. 121-129.
GenBank Accession No. U31794, "Human papillomavirus type 66, complete genome.", Oct. 1995. See http://www.ncbi.nlm.nih.gov/nuccore/1020290.
Letter dated Jan. 6, 2010 to EPO re EP 1 038 022 (46 pages).
Letter to EPO dated Mar. 2, 2009 re EP 1 0 38 0322 (15 pages).
Letter to EPO dated Oct. 6, 2008 re EP 1 038 022 (27 pages).
Letter to EPO dated Aug. 8, 2008 re EP 1 038 022 (11 pages).
EPO decision dated May 27, 2008 re Opposition of EP 1 038 022 (19 pages).
Letter to EPO dated Jan. 25, 2008 re EP 1 038 022 (10 pages).
Letter to EPO dated Jan. 23, 2008 re EP 1 038 022 (6 pages).
Communication from EPO dated May 14, 2007 re EP 1 038 022 (8 pages).
Letter to EPO dated Oct. 4, 2006 re EP 1 038 022 (11 pages).
Letter to EPO dated Apr. 18, 2006 re EP 1 038 022 (10 pages).
Partial International Search Report for PCT/US2009/062041, mail date Jan. 5, 2010.
Partial International Search Report for PCT/US2009/062041, mail date Apr. 8, 2010.
Thai et al., "An HPV 16, 18, and 45 genotyping test based on Hybrid Capture technology," Journal of Clinical Virology 45, S1 (2009) pp. 593-597.
Kitagawa et al., "Comparison of Poly(A) Poly(dT) and Poly(I) Poly(dC) as Immunogens for the Induction of Antibodies to RNA-DNA Hybrids," Molecular Immunology, vol. 19, No. 3, pp. 413-420, 1962.
Ishikawa et al., "Enzyme-Labeling of Antiboldies and Their Fragments for Enzyme Immunoassay and Immunohistochemical Staining," Journal of Immunoassay and Immunochemistry, 4: 3, 209-327.
Means et al., "Chemical Modifications of Proteins: History and Applications," Bioconjugate Chem. 1990, 1, 2-12.
Jakobovits et al., "Analysis of homozygous mutant chimeric mice: Deletion of the immunoglobulin heavy-chain joining region blocks B-cell development and antibody production," Proc. Natl. Acad. Sci. USA, vol. 90, pp. 2551-2555, Mar. 1993 Genetics.
Jakobovits et al., "Germ-line transmission and expression of a human-derived yeast artificial chromosome," pp. 255-258, Nature, vol. 362, Mar. 18, 1993.
International Search Report for PCT/US2009/041033, dated Dec. 22, 2009.
Sigurdsson et al., "Human papillomavirus (HPV) in an icelandic population: the role of HPV DNA testing based on hybrid capture and PCR assays among women with screen-dtected abnormal PAP smears," In: International Journal of Cancer, Jul. 1997, vol. 72(3), pp. 446-452.
Michele De Villiers et al., "Classification of papillomarviruses," In: Virology, Jun. 2004, vol. 324(1), pp. 17-27—see table 3.
GenBank Accession No. K02718, "Human papillomavirus type 16 (HPV16), complete genome.", Mar. 18, 1994. See http://www.ncbi.nlm.nihgov/nuccore/333031.
GenBank Accession No. X74479, "human papillomavirus type 45 genomic DNA.", Apr. 18, 2005. See http://www.ncbi.nlm.nih.gov/nuccore/397022.
GenBank Accession No. X05015, "Human papillomavirus type 18 E6, E7, E1, E2, E4, E5, L1 & L2 genes.", Apr. 18, 2005. See http://www.ncbi.nlm.nih.gov/nuccore 60975.
GenBank Accession No. J04353. "Human papillomavirus type 31 (HPV-31), complete genome.", Mar. 18, 1994. See http://www.ncbi.nlm.nih.gov/nuccore/333048.
GenBank Accession No. M12732, "Human papillomavirus type 33, complete genome.", Mar. 21, 1994. See http://www.ncbi.nlm.nih.gov/nuccore/333049.
GenBank Accession No. M74117, "Human papillomavirus type 35, complete genome.", May 10, 2002. See http://www.ncbi.nlm.nih.gov/nuccore/333050.
GenBank Accession No. M62849, "Human papillomovirus ORFs,", Jan. 26, 2001. See http://www.ncbi.nlm.nih.gov/nuccore/333245.
GenBank Accession No. M62877, "Human papillomavirus type 51 genomic DNA, partial sequence.", Oct. 29, 1999. See http://www.ncbi.nlm.nih.gov/nuccore/333087.
GenBank Accession No. X74481, "Human papillomavirus type 52 genomic DNA.", Apr. 18, 2005. See http://www.ncbi.nlm.nih.gov/nuccore/397038.

(56) References Cited

OTHER PUBLICATIONS

GenBank Accession No. X74483, "Human papilomavirus type 56 genomic DNA.", Apr. 18, 2005. See http://www.ncbi.nlm.nih.gov/nuccore/397053.
GenBank Accession No. 090400, "Human papillomavirus type 58, complete genome.", Dec. 7, 2007. See http://www.ncbi.nlm.nih.gov/nuccore/222386.
GenBank Accession No. X77858, "Human papillomavirus type 59, complete viral genome.", Apr. 18, 2005. See http://www.ncbi.nlm.nih.gov/nuccore/557236.
Yevgeniy S Belousov et al.: "Single nucleotide polymorphism genotyping by two colour melting curve analysis using the MGB elicpse TM probe system in challenging sequence environment" Human Genomics, Henry Stewart Publications, London, GB, vol. 1, No. 3, Jan. 1, 2004, pp. 209-217; XP001538494.
International Search Report and Written Opinion based on PCT/US2001/037012 mailed Apr. 17, 2012.
Lowe et al.; "A Hybrid-Capture Assay to Detect HPV MRNA Ratios in Cervical Specimens"; Journal of Virological Methods; vol. 179; No. 1; Jan. 2012; pp. 142-147.
International Search Report Based on Application No. PCT/US2012/026380 Mailed Oct. 15, 2012.
International Search Report Based on Application No. PCT/US2012/020684 Mailed Oct. 25, 2012.
Clad et al.; "Performance of the Aptima High-Risk Human Papillomavirus MRNA Assay in a Referral Population in Comparison with Hybrid Capture 2 and Cytology"; Journal of Clinical Microbiology; Mar. 2011; LNKD-PUBMED:21191046; vol. 49; No. 3; Dec. 29, 2010; pp. 1071-1076; Abstract.
Li et al; Detection of Human Papillomavirus Genotypes With Liquid Bead Microarray in Cervical Lesions of Northern Chinese Patients; Cancer Genetics and Cytogenetics, Elsevier Science Publishing, New York, NY, US; vol. 182; No. 1; Mar. 6, 2008; pp. 12-17; Abstract.
Gheit et al.; "Development of a Sensitive and Specific Assay Combining Multiplex PCR and DNA Microarray Primer Extension to Detect High-Risk Mucosal Human Papillomavirus Types"; Journal of Clinical Microbiology, American Society for Microbiology, Washington, DC, US ; vol. 44; No. 6; Jun. 1, 2006; pp. 2025-2031; Abstract.
Han et al.; "Simultaneous Amplification and Identification of 25 Human Papillomavirus Types With Templex Technology"; Journal of Clinical Microbiology Nov. 2006 US LNKD-DOI:10.1128/JCM.01762-06; vol. 44; No. 11; Nov. 2006; pp. 4157-4162; Abstract.
Database EMBL [Online]; July 19, 2007; "Sequence 25 From Patent EP1806410"; XP002675256; Retrieved From EBI Accession No. EMBL:CS642417; Database Accession No. CS642417; The Whole Document.
Database EMBL [Online]; Dec. 14, 2010; "Sequence 26 From Patent U.S. Pat. No. 7,812,144"; XP00267527; Retrieved From EBI Accession No. EMBL:GX640151; Database Accession No. GX640151; The Whole Document.
Database Geneseq [Online]; Jan. 22, 2009; "HPV-16 E7/E6 Gene Target Sequence, Bases 752-774"; XP002675258, Retrieved From EBI Accesssion No. GSN:ATS82292; Database Accession No. ATS82292; The Whole Document.
Database Geneseq [Online]; Jan. 22, 2009; "HPV-16 E71E6 Gene Target Sequence, Bases 698-720"; XP002675259 Retrieved From EBI Accession No. GSN:ATS82290; Database Accession No. ATS82290; The Whole Document.
Database Geneseq [Online]; April 1, 2010; "HPV16 E7 Gene Forward RT-PCR Primer SEQ ID 49"; XP002675260; Retrieved From EBI Accession No. GSN:AXU96631; Database Accession No. AXU96631; The Whole Document.
Database Geneseq [Online]; Apr. 21, 2005; "E7 Coding Region (1-87) Amplifying Sense PCR Primer, SEQ ID No. 37"; XP002675261; Retrieved From EBI Accession No. GSN:ADX15568; Database Accession No. ADX15568; Sequence.
International Preliminary Report on Patentability Based on Application No. PCT/US2011/037684 Mailed Nov. 27, 2012.
Japanese Notice of Reasons for Rejection dated Nov. 27, 2013, issued in Application No. 2011-533405 and English translation thereof.
Instructions RIPA Buffer (No. 89900 89901) [online] Thermo Scientific, 2006, [<Retrieved from the Internet: http://www.piercenet.com/instructions/2161782.pdf>].
Chinese First Action dated Apr. 26, 2013, issued in Application No. 201180012414.0 and English translation thereof.
Notice of Reasons for Rejection dated Aug. 26, 2013, issued in Japanese Application No. 2011-505244 and English translation thereof.
International Preliminary Report on Patentability dated Aug. 27, 2013, issued in Application No. PCT/US2012/026380.
Chinese First Action dated Apr. 15, 2013, issued in Application No. 201080018737.6.
European Office Action dated Oct. 18, 2013, issued in Application No. 11 726 003.4-1403.
Rychlik et al., "A computer program for choosing optimal oligonucleotides for filter hybridization, sequence and in vitro amplification of DNA." Nucleic Acids Research, 17, 8543-8551, 1989.
Chinese First Action dated Aug. 2, 2013, issued in Application No. 201180016276.3 and English translation thereof.
Molijin A. et al., "Molecular diagnosis of human papillomavirus (HPV) infections," Journal of Clinical Virology, 2005, vol. 32S at pp. S43-S51.
Chinese Office Action (Second) issued in Application No. 200980143682.9, dated Aug. 5, 2013, and English translation thereof.
Broker et al., "A Molecular Portrait of Human Papillomavirus Carcinogenesis", Cancer Cells, vol. 7, pp. 197-208, 1989 (Roche EU Opposition).
Higgins et al., "Transcription Patterns of Human Papillomavirus Type 16 in Genital Intraepithelial Neoplasia: Evidence for Promoter Usage within the E7 Open Reading Frame during Epithelial Differentiation", Journal of General Virology, vol. 73, pp. 2047-2057, 1992 (Roche EU Opposition).
Karlsen et al., "Use of Multiple PCR Primer Sets for Optimal Detection of Human Papillomavirus", Journal of Clinical Microbiology, pp. 2095-2100, Sep. 1996 (Roche EU Opposition).
Park et al., "Physical Status and Expression of HPV Genes in Cervical Cancers", Gynecologic Oncology, vol. 65, pp. 121-129, 1997 (Roche EU Opposition).
Stoler at al., "Human Papillomavirus Type 16 and 18 Gene Expression in Cervical Neoplasias", Human Pathology, vol. 23, No. 2, pp. 117-128, Feb. 1992 (Roche EU Opposition).
De Villiers et al., "Classification of Papillomaviruses", Virology, vol. 324, pp. 17-27, 2004.
Howley et al., "A Rapid Method for Detecting and Mapping Homology between Heterologous DNAs", Journal of Biological Chemistry, vol. 254, No. 11, pp. 4879-4883, Jun. 10, 1979.
Law et al., "Conserved Polynucleotide Sequences Among the Genomics of Papillomaviruses", Journal of Virology, vol. 32, No. 1, pp. 199-207, Oct. 1979.
Heilman et al., "Cloning of Human Papilloma Virus Genomic DNAs and Analysis of Homologous Polynucleotide Sequences", Journal of Virology, vol. 36, No. 2, pp. 395-407, Nov. 1980.
Howard et al., "Optimizing the Hybrid Capture II Human Papillomavirus Test to Detect Cervical Intraepithelial Neoplasia", Obstetrics and Gynecology, vol. 100, No. 5, Part 1, pp. 972-980, Nov. 2002.
Lorincz, A.T., "Molecular Methods for the Detection of Human Papillomavirus Infection", Obstetrics and Gynecology Clinics of North America, vol. 23, No. 3, pp. 707-730, Sep. 1996.
B.D. Hames, et al., "Nucleic Acid Hybridization. A Practical Approach." 1985.
Greg T. Hermanson, et al., "Immobilized Affinity Ligand Techniques." 1992.
Richard F. Taylor, "Protein Immobilization, Fundamentals and Applications." 1991.
Blair et al. "Herpes Simplex Virus Viron Stimulatory Protein mRNA Leader Contains Sequence Elements Which Increase Both Virus-Induced Transcription and tnRNA Stability." Journal of Virology, vol. 61, No. 8, pp. 2499-2508, Aug. 1987.
Larder et al. "Relate Functional Domains in Virus DNA Polymerases," The EMBO Journal. vol. 6, No. 1, pp. 160-175, 1987.

(56) References Cited

OTHER PUBLICATIONS

Chandler et al., Detection of Dengue-2 Viral RNA by Reversible Target Capture Flybridization., J. Clin. Microbiol., vol. 31 (10), pp. 2641-2647, 1993.
Mazzulli et al, 1999, Multicenter Comparison of the Digene Hybrid Capture CMV DNA Assay (version 2.0) the pp65 Antignenemia Assay, and Cell Culture for Detection of Cytomegalovirus Viremia, J Clin. Miorobiol., vol. 37, No. 4, pp. 958-963, 1999.
Murakami et al., Fluorescent-Labeled Oligonucleotide Probes: Detection of Hybrid Formation in Solution by Fluorscence Polarization Spectroscopy, Nucleic Acids Res., vol. 19 (15), pp. 40974102, 1991.
Dunn and Hassell: "A Novel Method to Map Transcripts: Evidence for Homology between an Adenovirus niRNA and Discrete Multiple Regions of the Viral Genome" Cetl, 12:23-36, Sep. 1977.
Coutlee et al., "Nonisotopic Detection of RNA in an Enzyme Imunoassay using a Monoclonal Antibody Against DNA-RNA Hybrids" Analytical Biochemistry 181:153-162, 1969.
Chen et al., "DNA Optical Sensor: A Rapid Method for the Detection of DNA Hybridization" Biosensors & Bioelectronics 13:451-458, 1998.
Chevrier et al., "Isolation of a Specific DNA fragment and Development of a PCR Based Method for the Detection of Mycobacterium genavense" FEMS Immunology and Medical Microbiology 23:243-452, 1999.
Hakala et al., "Simultaneous Detection of Several Oligonucleotides by Time-Resolved Fluorometry: The Use of a Mixture of Categorized Microparticles in a Sandwich Type Mixed-Phase Hybridization Assay" Nucleic Acid Research, 26:5581-5588, 1998.
Gelmetti et al., "Detection of Rabbit Haemorrhagic Disease Virus (RHDV) by In Situ Hybridisation With a Digoxigenin Labelled RNA Probe" Journal of Virological Methods 72:219-226, 1998.
Radtkey et al., "Rapid, High Fidelity Analysis of Simple Sequence Repeats on an Electronically Active DNA Microchip" Nucleic Acids Research 28:i-vi, 2000.
Namimatsu et at; "Detection of *Salmonella* by Using the Calorimetric DNA/rRNA Sandwich Hybridization in Microliter Wells" J. Vet. Med. Sci. 62:615-619, 2000.
Lazar et al., 1999 "Hybrid Capture®: a Sensitive Signal Amplification-based Chemiluminescent Test for the Detection and Quantitation of Human Viral and Bacterial Pathogens",1. Clin. Ligand Assay 22:139-151.
Newman et al., 1989 "Solution Hybridization and Enzyme Immunoassay for Biotinylated DNA:RNA Hybrids to Detect Enteroviral RNA in Cell Culture" Mol. Cell Probes 3:375-382.
Lamoureux et al., 1997 "Detection of Campylobacter jejuni in Food and Poultry Viscera Using Immunomagnetic . Separation and Microtitre Hybridization" J. Appl. Microbiol. 83:641-651.
Coutlee et al., 1990 "Quantitative Detection of Messenger RNA by Solution Hybridization and Enzyme Immunoassay" Biol. Chem. 265:11601-11604.
Stollar, B.D. and A. Rashtchian, 1987 "Immunochemical Approaches to Gene Probe Assays" Anal. Biochem. 161:387-394.
Blais, B.W., 1994 "Transcriptional Enhancement of the Listeria Monocytogenes PCR and Simple Immunoenzymatic Assay of the Product Using Anti-RNA:DNA Antibodies" Appl. Environ. Microbiol. 60:348-352.
Coutlee et al., 1991 "Detection of Transcripts of Human Papillomaviruses 16 and 18 in Cancer-derived Cell Lines and Cervical Biopsies by Enzyme Immunoassay for DNA-RNA Hybrids Following Solution Hybridization" J. Clin. Microbiol. 29:968-974.
Viscidi et al., 1989 "Monoclonal Antibody Solution Hybridization Assay for Detection of Human Immunodeficiency Virus Nucleic Acids" J. Clin. Microbiol. 27:120-125.
Boguslawski et al., 1986 "Characterization of Monoclonal Antibody to DNA:RNA and Its Application to Immunodetection of Hybrids" J. Immunol. Methods 89:123-130.
Coutlee et al., 1989 "Immunodetection of DNA with Biotinylated RNA Probes: A Study of Reactivity of a Monoclonal Antibody to DNA-RNA Hybrids" Anal. Biochem 181:96-105.
Coutlee et al., 1991 "Immunodetection of DNA with Biotinylated RNA Probes: A Study of Reactivity of a Monoclonal Antibody to DNA-RNA Hybrids" Anal. Biochem. 198:217 (Published erratum).
Coutlee et al., 1989 "Comparison of Calorimetric Fluorescent, and Enzymatic Amplification Substrata Systems in an Enzyme Immunoassay for Detection of DNA-RNA Hybrids" J. Clin. Microbiol. 27:1002-1007.
Datrymple et al., DNA sequence of the herpes simplex virus type 1 gene whose product is responsible for transcriptional activation of immediate early promoters, Nucleic Acids Research, 1985, vol. 13, No. 21, pp. 7865-7879.
McLauchlan at al., DNA sequence homology between two co-linear loci on the HSV genome which have different transforming abilities, The EMBO Journal, 1983, vol. 2, No. 11, pp. 1953-1961.
Goldsborough et al., Nucleotide Sequence of Human Papillomavirus Type 31: A Cervical Neoplasia Associated Virus, Virology, 1989, vol. 171, pp. 306-311.
McGeoch et al., "DNA Sequence and Genetic Content of the HindIII 1 Region in the Short Unique Component of the Herpes Simplex Virus Type 2 Genome: Identification of the Gene Encoding Glycoprotein G, and Evolutionary Comparisons," J. Gen. Virol., 1987, vol. 68, pp. 19-38.
McGeoch et al., The Complete DNA Sequence of the Long Unique Region in the Genome of Herpes Simplex Virus Type I, 1 Gen Virol., 1988, vol. 69, pp. 1531-1574.
Yamada et al., Human Papillomavirus Type 16 Variant Lineages in United States Populations Characterized by Nucleotide Sequence Analysis of the E6, L2, and LI Coding Segments, J. Virol., Dec. 1995, vol. 69, No. 12, pp. 7743-7753.
Swain et el., Nucleotide Sequence of the Herpes Simplex Virus Type 2 Thymidine Kinase Gene, Virol., Jun. 1983, vol. 46, No. 3, pp. 1045-1050.
Delius et al., Primer-Directed Sequencing of Human Papillomavirus Types, Current Topics in Microbiology and Immunology, 1994, vol. 185, pp. 13-31.
Blair et al., Herpes Simplex Virus Virion Stimulatory Protein mRNA Leader Contains Sequence Elements Which Increase Both Virus-Induced Transcription and mRNA Stability, J. Virol., Aug. 1987, vol. 62, No. 2, pp. 444-453.
Larder et al., Related functional omains in virus DNA polymerases, The EMBO J., 1987, vol. 6, No. 1, pp. 169-175.
McGeoch et al., Structures of Herpes Simplex Virus Type 1 Genes Required for Replication of Virus DNA, J. Virol., vol. 62, No. 2, pp. 444-453.
Eder et al., "The Next-Generation Hybrid Capture(R) High-Risk HPV DNA Assay on a Fully Automated Platform", Journal of Clinical Virology, vol. 45, No. 1, Jul. 2009, pp. S85-S92.
Stoler et al., "In Situ Hybridization Detection of Human Papillomavirus DNAs and Messenger RNAs in Genital Condylomas and a Cervical Carcinoma", Human Pathology, vol. 17, No. 12, Dec. 1, 1986, pp. 1250-1258.
Lornicz, "Hybrid Capture Method for Detection of Human Papillomavirus DNA in Clinical Specimens: A Tool for Clinical Management of Equivocal Pap Smears and for Population Screening", Journal of Obstetrics and Gynaecology Research, vol. 22, No. 6, Dec. 1, 1996, pp. 629-636.
Poljak et al., "Human Papillomavirus Genotype Specificity of Hybrid Capture 2 Low-Risk Probe Cocktail", Journal of Clinical Microbiology, vol. 47, No. 8, Aug. 1, 2009, pp. 2611-2615.
International Search Report and Written Opinion for Application No. PCT/US2011/037684 dated Aug. 5, 2011.
European Office Action dated Jul. 4, 2014, issued in Application No. 09 752 940.8-1403.
Japanese Office Action dated Jun. 30, 2014, issued in Application No. 2011-548258.
Chinese Office Action dated May 4, 2014, issued in Application No. 200980143682.9, English translation.
Luo et al., "Adiponectin stimulates human osteoblasts proliferation and differentiation via the MAPK signaling pathway," Experimental Cell Research, Academic Press, US, 309:1, (Sep. 10, 2005) 99-109, XP005037411.
Ouitas N. et al., "A Novel ex vivo skin model for the assessment of the potential transcutaneous anti-inflammatory effect of topically

(56) References Cited

OTHER PUBLICATIONS applied Harpagophytum procumbens extract," International Journal of Pharmaceutics, Elsevier BV, NL, 376: 1-2, (Jul. 6, 2009), 63-68, XP026185227.

Scholz et al., "Analysis of human immunodeficieny virus matrix domain replacements," Virology, Elsevier, Amsterdam, NL. 371: 2, (Nov. 8, 2007) 322-335, XP022439785.

Xie H. et al., "Apelin in and its receptor are expressed in human obsteoblasts," Regulatory Peptides, Elsevier Science B.V., NL, 134: 2-3, (May 15, 2006), 118-125, XP27895144.

Zhang W. et al., "Bone-Targeted Overespression of Bcl- 2 Increases Osteoblast Adhesion and Differentiation and Inhibits of Mineralization In Vitro," Calcified Tissue International, Springer-Verlag, NE, 80: 2, (Feb. 2, 2007), 111-122.

European Office Action dated Jul. 14, 2014, issued in Application No. 10 755 291.1-1406.

Japanese Notice of Reasons for Rejection dated Aug. 28, 2014, issued in Application No. 2012-508768.

Coutlee et al., "Nonisotopic Detection of RNA in an Enzyme Immunoassay Using a Monoclonal Antibody against DNA-RNA Hybrids." Analytical Biochemistry 181, 153-162 (1989).

European Office Action received in corresponding EP 11 726 003.4, dated Feb. 16, 2015.

Association for Molecular Pathology, Annual Meeting Abstracts, Oct. 29-Nov. 2, 2008, Grapevine, Texas, AMP Abstracts, JMD Nov. 2008, vol. 10, No. 6, pp. 1-70.

Castle, et al., "Restricted Cross-Reactivity of Hybrid Capture 2 with Nononcogenic Human Papillomavirus Types", Cancer Epidemiology, Biomarkers & Prevention, vol. 11, pp. 1394-1399, Nov. 2002.

Castle, et al., "Human Papillomavirus Genotype Specificity of Hybrid Capture 2", Journal of Clinical Microbiology, vol. 46, No. 8, Aug. 2008, pp. 2595-2604.

\* cited by examiner

FIG. 1A

HPV33 Deletion Probe Template (SEQ ID NO: 104)

CTGTAAAAAAAATATGGAAAACGTTTACGCCTGCGACGTAAAATAAATAAC
TAGGATGTAAAACAAAGTCAGCACCGTCTACAACAATGGTGTCAAAAGGAA
AAAAGGCGAAATAGGAACAAATGGGCTAGATGTGGGAAATAAAGGGGAAG
GTATATCAGGGCCAGACATAACAGGAGTATCAAATCCTGTATTTAAAGGTAT
AGACACATTGCTGGTACGTGTTGTTGCAAACGTACTGTATGAGTGTTGCATTG
GGGTGTGTACATTATCCACATCGTCAGCATAAACATCATACAAACCATCATTA
ATACTATAAGACGATGTAGAAGTATCATGTAAAGGCTGTAATTCATATTGTTC
ATTTGGCACGGTGTGGTCTAAAGGCACAATAGGACTTAAATCCTGATAATAA
TGTATTCTAGCTCCAATTTGTTACCACTGCGAGTTTTAAGTGTGGCTTTTGA
CCTACTCTACTAAAACGCACAGTATGTCTACGAGATGTAATAGCAGGCCTAT
GTAATGCAATAATATCTAGAAAGTCAGGATCAGGAGCAGGTGATATATCACT
ATGTTGAAATTGTAATGTGTCTTCAGGGTCAAAGCTTTCAAATGCAGGATTAT
CATATGTTATAAGTTTATGAGGCGATGTTAAAAAAGCAGGGTCAACAACCTT
AACCTGTTGGGTATTGCGACTATATAAACCAAGGCGTGCCACAGGGCGAGAC
CCTGGAATGGGCGTGCTTGATGTTACATTACTACTGTCTGTGGAAACAACAA
AGGTATCCATTGGTATGTTTTCATAACTTTGTGTGCTAACAGTAGGGGAAGAA
AATATAAAATGTCCAGAGGCTTCTGCAGGCGCTGGAGGGTGTAGTACAGATG
GTTCAGTAAATGTGGGATTTAAATGTGTAGAAATAGTTTGAATAGATGACTC
CCCAACAGATGAAACATTAATAATTGCAGGTGTAGTATCTGCAGATGTAGTA
ACATCAAAACCTGATGGTGTAGGAATAGATGGGGCTGGTGCACCTGCCTCTA
TAAAACTTGTTTCTTCTATTAATGACACTATAGACGAGTCTAAAGGTCCAACA
GTGTCTACAGTAACCGGAGGACGTATAGGCTGCAAGGGGATTGCAGCTGTAG
GTGGGTCAGTACCAATAGGTACATAGCCAGTCCTTCCACCTGAACCAGAGCC
TGTGCCAATACCTAAACCACCAAAAAAACCCCTAAACTGCCATATTTAAGA
ATTTGATCTGCTATGGTACTTCCTTCCACTTTAGGAATAACATCGGGTGGGCA
GGTGCCTGTGGCCTTGCATGTTGGTATAGTTGTGTTGCAGATGCACGCTTGC
GCCTTGTAGATCGTTTGTGTCTCATAATAATACACTGCTAAAATATAAAGGTA
TTTATTAGTAATACAAAAAAAAAAAAACTAAAATAACAACAACAATGTTAAA
ACACCACCATGTGCACATATACAAACAATATATACATGTATATACATTACT
CTTGTTGTGTCATATGCTGTGCATGAAAATTAATACACATCATTGGTAAATAT
AAAAACAACAAATAGCAAAAAAAAATTTTTAAAGGAGATCCCACAAACACC
CAAAGCAGCAATACCAACACCTGCAACCAAGCATAGGTAGAAATGGAAAGT
ATTAAAGGACGTAATAATAAGGATAAGCATAAAAACAATATAAAACATAAT
ACAAAAACAAATATCATGGTTATATACAATTAGCAGCACATATTGGCTTGTG
ATGTACACTTATAATGTCATAAATCCAGTACTTATTTGCACAGTAGGTGGTAT
TTTTACGGTACCTAAAAACATTTGTTGTTGCTGTTCAGTTACAAATGTTACAG
TTACAATTCCATTTTTACTATTTTGTTGTCACTGGTCCAATGCCAGGTGGATG
ACATAGAACTATACAACTCTTTATAAGGTTTTAATCTGTATCTTAAACATTTT
AAACTATTTGATTCACCTTTTAAATGCACTATAGGTGCAACGTTAGGACTACA
CACAGTCCGCTGCTTGTTTGTGCAGTTAGTTGCAGTACGTGCTGTTCTATTGTC
CAAGGCGGGGTCTGCACAGAACAGCTTTGTAAGGGGCTGGGCGGTGTCTGTG
GTGTCTGCAGGTCGTCGTCGTTTGGCCGCTGCTTGTGGTGGTCGGTTATCGTT

FIG. 1B

GTCTGTCTGTATGTCAGCAGTTTCAGTAGTGGATATTTGGTTGCTAGATATAG
ACGTAGGACAAACAATTACCTGACCACCCACATGTACTTCCCACATTTGTGTT
TTAGAATACTTTGCAGCATCCTCTTTAAAATATTTAAAATATACCTTTTCACA
GTTATGTATATAATACATACCTATATAATCTACTTTCCCTGTAACCATAGTAC
ATGTATCTTCCTCTATAATATATATTTCACCCCAGTTTGTATAATCCATTGTAT
TTTTTTTGTCATTGTCATATTGCACAGTTACTGTTTCTCCTTGTTTTTAAAACA
TTTTGGTGGTTCACAAAGCCACACCTCTAAGCTTGTTTGTTGCAATGTCCAT<u>T</u>
<u>GGCTTGTACTATACTGTGATTTACTTAATG</u>tctctaatgccatttgtagttcaattacttgaaatgct
ttggtctttgatgctaacaaagaaggcaccacctggtggcataaatgtgaaaatcccatttgtttggctgtatacaataaagcacact
ccatgcgtatcagttccaatgttcaatttgtgatggtaaatcagttttatcagcttcgtaaagagctagcattttctcctgcactgcattt
aaacgtgctgatatttcctccatggttttccttgtcctcttcctctattaaatctaatttgcaccacgtccttgagaaaaaggatttccaat
tttcatcatttattgcatacactgggttaccattttcatcaaatgggaatggattttaaattcaaatactgttaatctactatgtaaatatg
gccatctagagtctgtgcctgcatttgtatttgaggtaagaagcagtggtggacattttaattgcactaatgccctatgtttcacatcta
ttgaaatttcatttccatctaacgcatttctcatgtaatcatctatatatgtccaacttattggcgttacatcatctatcattcctattttttgca
tctgataatggctgcaaccaaaagtgacttttagaatttacacatgatataacacacccttttaaaaactgtattaaactcattccaaaa
tatgactttcctgtatttgctggtccacaaattagcatacagctttttttggtatacctttaaaaacttttaaatgcacctaaaaatgct
gtaaattcaatgttttgatatcttaacaactgtactattggtctccaatttcctccatcatttgtttttcacatctactttgtatccattgtcct
attgacatttacgttttctgcttttttataatgtctacacattattccacagtcctttactattttgcttgtgagttacttttaaaaatgcag
cagcattactatttgaatctgcaagttgtgcataataatatgcaatgtcactatcgtccgttaactcgttatcatatgcccactgtaccat
ttcacttaaatcaaatatattatcattaaagctatgttgtaaaacagttagtctatctatccattcaggtgttgtaccttgtacatcactaat
gtttgacattgctgttctaaaccaatacaatgcacatgtttggctccgtaattttggtggctctataaccatacatgtttcaggtattgat
aataaattactcattagttttgctactgttaacctgttttgctacacctaaatctaattaacaataatattattattcctctatcgcaagtta
aacattgtaaatgagtatacaaactatgctgtttaattaatactttaaactttctgctactgatggactaattccatatcctgttatacac
caatctgtacagcttgttttatcacttttaaatgg<u>TCTTACTAATTCCATAAAACTTATTCCAT</u>AGG
CCTCTTTAAATTTATATAATATATTTGCTTTTGTATTACTACTATGTAGAACAT
TACTAATTTCCTGCAACGTAACATTTTCACAGCTATCTACATTTGTCTCACAG
CTTACTTCTGAATCATCCCCCACCCCACTAGATTCTAAGTCATTTAAGTTTGTG
TCGCCATTTTGACTTTCTACCTGTTGTACCATCTGCTGAGTTTCCACTTCAGTA
TTGCCATATCCGCTGTCTTCTAGCTCATCTATTTTCGTTTTCTGTATGTGCATT
CTTTATTTTTATTAATAGACGTTCTACACGGGTTTGCAGCACGATCAACAACG
TCCTCCGCAGCACTTTGTAACATGCGGCAAACTTTCGTTTTAGTGCACACAC
AGCATTTAAATCATCCTCCCCTTCCTGTATATTAAACAATGCCCGGGCTGCCT
CTGTGTCTGCCTGTATACTATTTTCCATAGAATCATCTATAAACTCTAGTAAA
TCCGTGCCACTGTCATCTGCTGTTTCATCCTCATCTTCTGAAATATTATCTCCT
GTTCTTCTCTATGACTGCTTCTACCTCAAACCAACCAGTACACCCCATCCC
AGCCCCATTTGTACCTTCAGGATCGGCCATTGTAGATGATGTTTATTGTTGTG
CACAGGTAGGGCACACAATATTCACTGTGCCCATAAGTAGTTGCTGTATGGTT
CGTAGGTCACTTGCTGTACTGTTGACACATAAACGAACTGTGGTGTTACAAGT
GTGACAACAGGTTACAATGTAGTAATCAGCTGTGGCTGGTTGTGCTTGTCCAT
CTGGCCGGTCCAAGCCTTCATCCTCATCTGAGCTGTCACTTAATTGCTCATAG
CAGTATAGGTCAGTTGGTTCAGGATATAAATCTAAACATATTCCTTTAACGT
TGGCTTGTGTCCTCTCATGGCGTTTTACACGTCACAGTGCAGTTTCTCTACGT
CGGGACCTCCAACACGCCGCACAGCGCCCTGCCCAACGACCCGAAATATTAT
GAAATCGTTTGTTTAAATCCACATGTCGTTTTTTTCTTGAGGACACAAAGGT
CTTTGACATATAATACACCTAATTAATATTTCATTTAAAGGTTTTTTAACTGTT
TGTTCTAATGTATTTCCATATACAGAATAATTATAATGTCTATATTCACTAATT

FIG. 1C

TTAGATAAGAACCGCAAACACAGTTTACATATTCCAAATGGATTTCCCTCTCT
ATATACAACTGTTAAATCTGCAAATGCAAAATCATATACCTCAGATCGTTGCA
AAGGTTTTTTGCATTCCACGCACTGTAGTTCAATGTTGTGTATAGTTGTCTCCA
ATGCTTGGCACAAATCATGCAATGTTCGTGGTTTTCCTCAGTGTCTTGAAAC
ATAGTCGTGCAGTACCTTACTGCAAAATGGTTGCTTTATATATGCACCGTTTT
CGGTTGAACCGCTTTCGGTTACACCCTACTTTTTTAAAACTTGGCATTATAGTT
TACTATTATATAAAAGATTATAAATGACCAATATGACCTAAAACGGTTAGTC
CACACCTGGTAATAAACAGGTAGTGACTCACTTTTACAAGGCATAGTTTGGC
ATACAAAGCAATTGTGTAAGCCAAAACTGCACTTAAGGTTTGAAAGTAAAGT
AAAAATATGTGCCTAAAAGCATGTGTAAACTATTAGTACAATTAAGTATTTTG
CAATTGCACTGCATGTATATGAGTCAATGCAGCAAGTACAGACAAACACA
GTGCAGGAAAGAAAAGGATTAACTGTTCTGCCAATGTCATAGGGTATGTATG
CCAATGCAGCAAGTACAGACAAACACAGTGCAGGAAAGAAAAGGATTAACT
GTTCTGCCAATGTCATAGGGTATGTATGCCAAGTAACCGAAAACGGTTAGGC
ATACAAAATGGAGGAAATTGTACAATATGGACACTAGTATGTCAAAAGGTAA
AGCAATACTAAACATGTAGGTACTACAAATATAGGGAAATAAAGGTAGGTAC
ATTGCAATGCAGGGTAGGGCAAGCAATACAACTCCTTACTCATATAGGTACA
CCCATATACATAACATACATACAAATAGTTTAACAAATACACACAATGTTTTA
TTAACATATACACAAACAGGAAACTGACAAGTACATAGAACATGCACACAA
ACAAGTACACATAAAACAAACACAGTAACATACAACATAACATACATTGTAA
CACATACACAAAAAACAAACAACAACACAACACAACAACACAAAGTACATA
GACAGAACAAAACAACAACATAACACAATTACACAAAGTGTTATTTTTTAAC
CTTTTTGCGTTTTGCAGACGATGTGCGGGTGGATGTGGGGGCTGCACGTTTAA
GTTTAGGTTTTGCTTTAAGACCTGCCTGTAATAAAAACTTGCGTCCCAAAGGA
AACTGATCTAAATCTGCTGAAAATTTTCCTTTAAATCCACTTCCCAAAATGT
ATATTTACCTAAGGGGTCTTCCTTTTCCTTTGGAGGTACTGTTTTTGACACGT
AATAGCCTGAGAGGTAACAAACCTATAGGTATCCTGTAAACTAGCAGATGGA
GGAGGTGTTAAACCAAATTGCCAATCTTCTAAAATATCTGGATTCATAGCATG
AATATATGTCATAACTTCTGCAGTTAAGGTAACTTTGCATAGTTGAAAAACAA
ACTGTAGATCATATTCTTCAACATGTCTTATATATTCTTTAAAATTTTCATTTT
TATATGTACTGTCACTAGTTACTTGTGTGCATAAAGTCATATTAGTACTGCGA
GTGGTATCTACCACAGTAACAAATACCTGATTGCCCCAACAAATACCATTATT
ATGACCTTGTGCACGTTGTAGCCAATATGGCTTATTAAATAACTGAGATTCGG
AAGTAACCATTGATCCACTAGGAGTGGGAAAAAAAGCACTGCTTTGAATAGA
GGCAGTAGTTCCTGAACCTTTAATGTACAGGTCATCGGGAACAGCCTCCTA
ATGTACCAGCCCTATTAAAAAGTGTCTTACAAACATTTGTTCACGTCGAAGA
AAGAAAAATAAACTATCACCATAAGGCTCACTAGTCATTTTAAATAATCTG
GATATTTGCATGTACTGCCACAAATATCAATAGGAACATCACTTTTATTAGCC
TGCGATGTTTTAAAATCCATGCAACCAAATCCTGTGTCCACCATATCACCATC
CTCAATAATAGTATTTATAAGTTCTAAAGGTGGACAATCATTGGCAGGTGCTG
CATTAGTACAAGCAACACCTTTACCCCAATGTTCCCTGTTGGAGGCTTACAT
CCAAGTAAACATAACTGTGTTTGTTTATAATCCATGGATAAACATTCCCTATT
ATCAGCACCCGGTTGTCCAGGATACTTGTTACCGGTTTCAGTGTCATCAAATT
TGTTTAATAAAGGATGACCACTTATGCCAACGCCTAATGGCTGCCCTCTACCT
ATTTCAAGGCCTACACATGCCCATACTAATCGTTGTGTATCAGGGTTATAAAA
GGAGGTGTCAGGAAATCCAAATTTATTAGGATCTGGTAAACGGACCCTAAAA

FIG. 1D

ACCCTATATTGCAAGCCTGATACTTTGGGTACCAATAATTTTTTAGCGTTAGT
AGGATTTTTAATAGAAAAATATGGATGGCCAACAGCAAGAAGTCTGGAACTA
CCAGCATAATAATAAATGCTTGTGCGAGACACATATTCATCAGTGCTGACAA
CTTTAGATACAGGTACAGGAGGCAGGTACACTGTGGCCTCACTAGACCGCCA
CACGGACATC

FIG. 2A

HPV39 Deletion Probe Template (SEQ ID NO: 105)

CTGAAAAAAAATAGGGAATACGTTTCCGTTTTTTTAGGAAAAAATACAATAA
TGGCAACAAATAATAATTGGAACCCTGAATGGTTATTGCATATGTTGTGTCTA
TTGGTCCAGAAGGCACCAATGGCAACTGTGGAGTAGTACTTGGTAAAGCAAT
ATCAGGACCAGTATTTACAGGCATATTCCATGAGGTACTAAAAGGAATAGTT
GTATTGGCATATTTAGTAGATGCTGAAGAAGCCACAGAAGGTAGTGAGCCTG
TGTTATATGTAGTGCCCGAATCCCTTGTATTATTAAATGCAGTATCTAAATAT
GTGTTATTGTCCACATCAGCATATATATCAAATAATGCATCTGAAGCATCAGA
GGGCTCAGCGTGAACTAGGGGCTGTAATTCAATGCTTTCAGCAGGAGCAATA
CTACTAATGTCATGGTAATAATGTACTTGCGCTCCAATTTGTGTGCCACGCCG
GGTAACCATGGTAGCCTTTTGCCAAGCCTACTAAACCTTACTGTTCCTTTAC
GCGAGGTTAAGGCAGGCCTATGTAAACGAACAATGTCCAGAAAATCCGGATC
TGGAGCTATGTCAGCAGCTTCATATGTTAATGTAGTATCAACAGGCTCAAAA
GCAGGATTATCAAATGTTACAAATGATGAAGGGTGAGTTACAAAATCAAAAT
TACTAACACGAACCTGCTGATGTGCTCTACTATATAAACGTGGTCCTGCCACA
CGACTGATTCCAGGTGTAGGTGTGCTGCTAATAGGTTCGGTACCTGTGCCATG
TGTGGCAAACACTTCCATAGGTATTTCCTCATAGCCATGTGTACCTGATGTAG
GGGTACTGACAAATATATTACCCGAGGTTTCACCTGTTTGGGGAACCTCAATT
AAGGAAGGATCCGTAAAGGCAGGGTTAGTATAACTAGTAGAGGTTATTTGTA
CAGACCCAGAGGAGGGTGTAATATTCAATACCGCAGGCGTAGTAGTAGAAG
AAGAAGTAATTTCAAATCCAGAGGTGCCTGTAAATGTTGGTACTGGTGTTCC
AGAGGTTATAACACTTGAGTCCTCACCAATTGCACAATAGATGGCTCAGAA
GGACCAACAGGTTCAATAGCTACAGGTGGACGTGCAGGAGACACATCTACAA
CAGTATTAGGCCTACCCCCAGGGGTATATATCCTGTGCGTCCCCAGTACCA
GTACCTGTGCCTATGCCTAACCCACCCAAAAATATACCTAAACCAGTCCACT
GTAAAATTTTGTCAGCAAGTGTAGTACCCTCAACTTTATCAACAACGTCTGGT
GGACAGGTACCCGATTGTTTACAGGTTCTATATAGGTCAGTTGCAGATGCAC
GCTTACGCCTGGCAGCACGGTGGGAAACCATGTTTATTAGTAACAAAAAAAA
ATATAAAAAGCTATGTACAGTAGTTATGCACAATGCACATACATATACAGTA
CTATATCATATCCATTGCCAGTCTATGCAACAACCACATGGGCAATACAAAA
AATAGTAAATATACAAAAAACACCTCCAATGGTGTGGTACGTATAAGAATAA
ACACAAACACAATTATCCACACATACGCACACACATGCACAGACGGCAAAA
GCGGGACATTGCAACATATATATACACACACCAAACCACACCAAAAATAC
CAATAATATCATCTATGTAGTATGTATACAATATACATACACAATACCCATAG
TATACTTTACAATGTCATGTAACCCAATGAAACATGTACACTAGAAGGTATTT
TAACAGTGTCCAGAAATTTTTGGCGTTGTGACTCTGTGGCATATGTAACAGTT
AATATGCCAGCGTTTTTGGTTCCCTTACCCCGTATCCAATGCCAGGTACATGA
AATATTTTCAAACAATGTGTCATATTTTTGTAGTCTATATCTTAAACATTTTAA
ACCATTTTTGTCACCTTTTAAATGTATTATAGGCGTAGTGTTACCACAACTGA
GGTACCGTCTTGTGTTGTGGCCTGTACTGTTACTGTGGAGTGGGTTGTTAAGA
TGGTCCAGGGACACTCCGTCGGGCTCAGTGGGCTCTGTGACTGCACACTGTC
GAGGTCGCTTTCGAGACGGCGGCGGGATTGTTTTTTGGGTGCATGGGGTTGTT
GCGGTGGAATGGGTCGCGGTGGTGTTTGATAATTCGGTAGTAAGTTcagtagt
gggtaccgatccgtcactggtactgcacatagagtccggacaatgaattatgttgccattataatgcacttcccatttgccactagtc

FIG. 2B ccataccttccgcatcttgaataaacacttcatagtatacttttaggtgctcgttcatataatatataccccaatagtccacacacccttctgttttacaccatatgtctatattattttttataatatatagcaccccataatacatagttcatagcattacatttgtccccatcataccacacctccactgtagttccttgttttttaaaacattgttttggctgtgtatgccacagttcattactagtgtctttaatgtccactcctctgtattgtattcagtttgtgcaacactttctagtgccatctgcagttcaatagcttgatatgctttacattttgaaatgtttatggttggcaccacctggtggtcaatagtatgcatgccacgttctcgtgctgcataaaatattgcattttccattcgcacacattccaataattaatttgatcatatattgatttactgtcttgttcatagtattctagtattttgtcctgtaacacatttaaacgttgtgaaagtgttttcatcattgtctccttcatcctcgtcctgctgcaagtctaatctgcaccaagtcttttcaaaaaaacattccagtttttatcattgattgtgtacactggattcctgttttggtcaaatggaaatgcattaggaaatttaaacactgttagcctactacgtaaatatggccacctatcgtcttccacaggattggtattggaggttattaataatggtggacatttcatttgtagtaaactttatatttcctatctaaacttattgcatacccatctaatgcatttctcatataattatcgaaatatgaccagcaggtaccggttgcatcatctaacattgctagttttgcatctgcaagtggttctagccaaaagtggctggtggagtttacatatgaaataactgtgccctgtaaaaaatgcataaggctcatacaaaaatgtgactttcctgtattcgcaggcccatatataactatacagtttttttgggagtacccttttaaaaattcctttaatgcacataaaaaggatataaattctattccttgatatcttaagaattgtactatgggtctccagtccccgccttcatcacatttactacacctaaatttatccattgagacatggacatttgccttttttgtgctcgcttgtaatgtttacacattgttgcacaatcttttacatattttgcctggcagttacttttaaaaaggctgcagcattactgttacaatctgctaacattgcataattaaatgctatgtcactttcatcagtatattcattgtcaaatgcccattgtaccatgtccgataggtcaaatacactatcatctattccatgttgtataacagttaatcgttgtatccattctggcgtatccctgttaccacactaatattggatatacctgtgcgataccaatatagtgctgctacagggctgcgcagtttaggaggctccagaagcatacaactttctggaacatgtaacaatgtactaatccctttcctacagtaacccctattttttccacatgtatatctt<u>ATTAGCATTAAAATTAGTACTCCTTGT
TT</u>TGTGTCTAAGCTTTGTATATGTGTATATAAGGCATATTTGTTGATTAATGTT
TTAAATCCTTCTGCAATAGTTGGATGTACTCCAAATATGGCTGCCACCCAGTC
TGTACATGTTGTTTTATCACTTTTAAACGTACGTACCAGGTCAGTAAAGGAtA
GTCCATATGTTTCTTTAAATTGTGTTAGCATTGCAGCCTTTTTGTTATTGGATT
GTAACAATAATTTAATTTGTGCAGTTGGAGATTTGGGATCCTGGTTTTCACTA
TCTATAGCACTATCCACACTACTACACTCCTCCCGTACACTGCCGCCATGTTC
CCCTTCAGCATCCCCATTTGTATTAGTTGCTACAGTTACCTCCTCCACTTCAGC
TGTTTCCACTTCCATATTGCCATATCCGCTGTCTGGCACGGAATACACCGTTT
GTGTTGCCTGCGTACTGCTTACATTTAATGAAATTTCCTGTAGTGTTCCCCTGG
TATTCCTGCCTACTTTTTTTCCATACGGTCTAGTGTCGCCACTGCTGTCTGTAT
ACTTTCGTTTTAAGGCACGCACTGCTTGTGCATCCCTTTGGGCCTCTTGCATAT
GTAAAAGTACCTGTGCTGTCTCACGCTCTGCCTGTACACAAATATCTGTGGAA
TCATCAATAAAGTCTGCCAGGTCTGAACCTGTATCTGTTGCATTTTCATCCTC
ATCCTCCGACACTGTGTCGCCTGTTTGTTTATCTACTATTGCCTGTACTAGAAA
CCATCCGTTACATCCCGACCCATCCCCGTCTGTACCTTCACGATTGGCCATAG
CAGGTTACTGGTTTGCAGTTGCACACCATGGACACACAAATCCTAGTGAGTC
CATAAACAGCTGCTGTAGTTGTCGCAGAGTATCCCGTGAGGCTTCTACTACCA
GCTGCAGTGTGTTGTTACACTTACAACACGAACACTGCATTGTGTGACGCTGT
GGTTCATCCCGTCTGGCTAGTAGTTGATGTTGGTGATTAACTGCATGGTCGGG
TTCATCTATTTCATCCTCTGACTCTCCTAATTGCTCGTGACATACAAGGTCAAC
CGGCTGTATTTCATTGTAAGGACATAAATCTAATACAATTTCCTGCAAGGTGG
GCTTTGGTCCACGCATATCTGATGTTATACTTGGGTTTCTCTTCGTGTTAGTCT
GCGGTCCTCCCGTTTGTGGTCCAGCACCGTCGACACTGTCCTGTATAGCTTC
CTGCTATTTTATGAAATCTTCGTTTGCTATTTAGGTGTCTTAATTTTTCTGCTG
GACACAGCGGTTTCAGACAACACATGCACCTTATTAATAAATTATATAACTTT
GTATTAGTTATATTTTCTAATGTAGTTGCATACACCGAGTCCGAGTAATATCG
TAGCTCCCGTATTTTAGCATAAAATTTATACATGATTGGCATGCAGCTAGTG
GTTCCCCGTCCCTATATACTACATATAAATCACTAAATGCAAATTCATATACC

FIG. 2C

TCGGTTTGCTGTAGTGGTCGTCTGCAATAGACACAGGCTATTGTAATGTCCTG
CAAGGTGGTGTCCAGCGTTGTGCACAGGTCTGGCAATTTGTATGGCCGTTCTG
CAGGATTGTGAAATCGCGCCATCGGTATGGACAGAAACTGTGACTGCGTTTT
ATATCCACCGATTTCGGTCCTGACCGTTTTCGGTTACTCCCTTTTTTTAAACAA
GATACTTATAAAATGTTATAAGTAAAAGTATAGGTATGTATGCCCAACCTATT
TCGGTTGCATAAACTATTGTGTGCTACATTAGTCACTTGTATAACTTATACTG
TAAGACACATTCCTGAATCAAAAAGTAGTTATACAGGCCAACTATTTAATTA
AGCAAGTAAAAACAGCTAAAATATATGCCTAAAAGCAGTTTTATTACATAGG
GTGGAGATATGGATGTTGCCAAAGTATTGTTGCAGTGCACCTGGACAGGATG
ATGAGTAATAAGGCGCGCCAGTAAAACTGTTACCAGTGCCAACTATGCAGGG
TGAACCTAAGGTAAAGACATGTTTTTGCTGAGAAAGGTGGTTTCCACTAGTTT
AAAAAAAATGCTCAACCCACGACCGACTTCGGTCGCCACAAAATGGCGAAGT
ATAAAATGTAGAAACGCGTACAACAATGTAAAAATTACATATTAGGTAGTAA
ACACACCTTAGGGTAGGGCATATAGATTATGTATGAAATGTTGCAGACCTAT
TATATGTAAAACAAATACACTGTTAGTCACAGGGTGTGCAATCACACATGAA
ACTGTCATACATACTTTATTAACAAAAACATATACACACATACCTACAAACAT
ACACATATACACTCAACACATAAGGAAACAAACAACATACACACATAAC
AAGGCATACACATGCATTATTTAGACACACGTTTACGTTTGTGTTTAGTAGCT
GAGGACGAGGAAGTGGATGCAGCAGGCCGCTTTCGGGGACCTATGGTAGGG
CGCCTGCGGACCCTGGCCTGCAACAAAAATTTACGTCCCAAAGGGAATTGAT
CAAGTTCCAAACTAAACTTTTCCCTTAAGTCAACATTCCAAAACTTTAGACCG
TCATATGGATCTTTCTTTTCAGGTGCTGGAGCATCCTTTTGACATGTAATGGCT
GCAGACTGTAGGTATCTGTAAGTGTCTACCAAACTGGCAGATGGTGGAGGAG
CTACAGCAAAATTCCAATTGTCCAATATAGAGGAATTCATAGTGTGAATATA
AGACATAACATCAGTTGTTAATGTGACAGTACACAGTTGAAATATAAATTGT
AAATCATACTCCTCCACGTGCCTGGTATATTCCTTAAACTTAGAAGGATCATA
TGTAGAAGGTATGGAAGACTCTATAGAGGTAGATAATGTAAAGTTGGTACTA
CGGGTAGTGTCCACAACAGTAAGAAATAATTGATTATGCCAACATATACCAT
TGTTGTGGCCCTGGGCCTTATGTAGCCAATAAGGCTTATTAAATAACTGGGAA
TCAGAGGTTACCATGGAACCGCTGGGAGAGGGGCAGTATACAGAACTACCG
GGGTTTGCACGTATATCTGTGCCCTTAATA<u>TACAATTGGGCAGGAATGGCG</u>
<u>TCACCCACC</u>ataccaccacgattccaaaaatgtcttgcaaacagttgttccctacgtaaacagaagaacatactgtccc
atacacatctgcagacatttgcaaataatcaggatatttacaaatggattgacaaatatctaaaggcacctcacttttggtttcctgca
atgcaccaaagtccatagctccatagccag<u>TATCAATCATATCACCATCCTCAATAGGGG</u>TG
TTTACTAGTTCCAAAGGAGGACAGTCCCCGTAGATACATTATTGGGCTTGCA
TGCCTTTCCCTTACCCCAGTGCTCCCAATGGCGGGAACACAGCCTATAATGC
ACAACTGTGTCTGTTTATAATCCACAGACACATTATCCCTACTGTCCTTATTG
GTGGTTGATGAAAATGGTGAGTTTTCAGTATCATCCTGTCTATTATATAATGG
GTGTCCACTAATACCAACACCCAATGGCTGGCCCTGCCCACCTCCACCCCTA
CACAAGCCCATACTAAACGTTGTGTTTCTGGATTATATAAGGATGCATCTGGA
ATACTGAATTTATTAGGATCGGGCAATGTCACGCGAAATACCCTATATTGATA
TGCAGACACCTTTGGAATGTCCTGCTTGCGACCACCATTCATCCCACTTTAA
AATATGGATGTCCTACTGTTAATAATCTAGAGCTGCCAGCATAATAATATATG
CCTGTGCGTGTAACATAATCATCAGTATTGACAACCTTCGCCACAGAAGGTG
GAGGCAAATACACCATGCTGTCACTAGACCGCCACATAGCCATC

FIG. 3A

HPV52 Deletion Probe Template (SEQ ID NO: 106)

CTGTAAAAAAATATGGAAAACGTTTACGCCTGCGACGTAGTAAAAAATAACT
AGGATGTAAAATAAAATCTGTACCATCAACAATAATAGATGTAGATGGAGCT
GTAGGGGCTATAGGAACAAAAGGAGTATGTGTGGGTAACGAAGGTAATGGA
ATGTCAGGACCTGACTCAATGGACATAGTGGGTTGATATACAAAGTCAATAC
CACTATTAATAGGTACAGTGAAAGTATTATTATGGGTAGAAAGTGTGGAAGG
TAAGTGAAACGTGGGTTGCTGCAAAGAATCTGCATACACATCATACAAACCA
TCATTAATAGTGTAAGGGGACACAGACTGTGGTAATAAAGGTTGCAATTCTA
TGTCTTCCTGAACTTCAGCAGGCTGGATAGGACTAATATCATGATAATAATGT
ACCCGTGCCCCAATTTGTTTCCACTACGTGTACGTAGGGTGGCCTTATTACC
AAGCCTGCTAAACCTAACAGTACCTCTTCGAGAGGTTAATGCAGGCTATGC
AAAGCTATAATGTCTAAAAAATCAGGATCCGGTGCAGGTAAAAGTTGTGAAC
GATCAAAAATTATAGTTTCATCTGTATCAACGCCCTCAAAAACAGGATTGTTA
TATGTTACTAATTTCTGTGGTGATGACATAAAAGCAGGGTCGACTACCTTAAC
CTGTTGTGTGGCACGGCTATATAAACCAAGGCGTGTCGTAGGGCGAGACCCT
GGAATAGGTGTACTACTTGTTACACTGCTGCTGTCAGTAGAGGTAACAAATG
TATCCATAGGGATTTCTTCATAGGTGTGTGTACTAATAGTTGGACTAGAAAAC
AATACATGACCAGATGCTTCTGCAGGTGCCGGGGGCTGTATTATAGATGGTT
CAGTGAATGTAGGATTTAAATGTGTAGAAACTGATTGTACAGATGATTCACC
TATAGATGTTACATTAATTATTGCAGGAGTATTATTTGCAGATGTTGTAACAT
CAAACCCTGTTGCTGATGGAATAGATGGAGCAGGTGCGCCAGACTCAATAAA
TGTTGTTTCTTCTATCATAGAAACTATAGATGGTTCTAAGGGACCAATGGGTT
CTACAGTTACAGGGGACGAATGGTGGACGTGGTAATACTACTAGTGGGAGG
ACGAGTGGACAATGGCACATAGCCTGCCCTACCACCAGAGCCTGCACCTGTA
CCTATACCCAAACCTCCAAAAAACACCCTAGGCTGCCATATTTTAAAAGTT
GATCTGCAATAGTTGTGCCTTCCACTTTAGGAATAACATCGGGGGGCAGGT
GCCAGAGGCTTTGCATGTTTGATATAGCTGTGTTGCAGAAGCACGTTTGTGCC
GTGTAGACCGTCTGTATCTCATTGCGACAAGCTATTAAAAATATAAAGTA
TTTATTAGACAAACTACAAAAGTGAAAAGTATATTTTGCATATATGCATGTA
GCCAATCTACATGTACAGTTATTGCAGTTGTGCCAAATACTGTGCATGACAGT
GAATACAAAACATTGGAAAATATAAAAACAGTAGGTACAAAAAAAACACTT
TAAATGGTGACCCAATAGATACCCATAGCAAAAGCACCAGCACCAACACCTG
CGCATACACCGATATAGATAGCAAGAGCGGCCTAAGCACTGCACAAAACAC
CATAAGCAAATAAAACAAAATACAAATAATCCTAACATTGTTATATATACA
CAATAGCAGCAATATTGGCTTGTGTTGGGTGTTACCATACACATATACATAT
ATACATATGTACAAATATCACAATGACATGACACCTTGTATAACTTGCACAGT
ATTTGGTATTTTAACAGTTTTTAAAAATTGTTGACGTTGTGTTTCATCACTGTA
CGTTATTGTTACAATACCTAGTTTATTATTTGTACATTCATTACTGGTCCAATG
CCAGGTAGATGAAATTTGAACATACAAACTTTTATGTGTTTTACCCTATATC
TTAAACATTTTAAACTATTAGGATCACCTTTTAGGTGTATTATAGGTGCAGTA
CAAGTTGTATGTGCAACCCGTCCTTTGTTTGTGCACTCAGTTGCAGTGACGAG
TCCCCGTGTAGTACTGTCCACGGATTGTTGTCCCCGCAAAAGGTTGTTGGGGT

FIG. 3B

ACTTGGTGTTTCTGGAGTCTGTGACGTCTGGTCGTCGTCGTTTCTGTGGTGGTT
GTAGGTGTGTCTTTGGCACCCACGGACACTGCGGAGGTCTTGGAGGTTTCG
GTGCATAGGTGGACAGCAGTTTCAGTAGTGGATACTTCGTTACTAGATACAG
ATGCAGGACAAACAATTACCTGACCACCCACATGTACTTCCCATACTCCTGTT
ACACAATATTGCTTTGCATCGTTACTAAATTTTACAAAATATATTTTTTCTCCA
TCACACCAATAATATAACCCATAGTAATCTACTTGTCCTTCTACAATTGTACA
TTC<u>ACACTCACCAAGTAAATAAATTTCCTT</u>ccagtttgtataatccatagtattgttttatcattatcgt
attgcactgttattgtatacccatgttttaaagtattttgtggttctgcacgccacatttctagacttgtttgttgtaatgtccatccatct
gtgctatattgtgttttgtttaatgcctccaatgccaattgtagttcaatagcttggcaggcctttgccttagacactgccattggtggc
accacctggtggcctatatgagttattcccagttcctttgctttgtaaaacaaaacacattccattcgagtcaatttccaatgttcaattt
gtgcgtttaggtcattactatcagcttcgtatagatctagtattttttcctgcactgcatttaaacgtgccggtatcgactccatcgtttc
cttgtcctcttcctgtattaaatctaatttgcaccacgtccttgagaaaaaggatttccaattttcgttgttaatttcatatataggattgcc
attttcatcaaatggaaatgggttttgaaatgaaacacaaccaatctactatgtaaatatggccacctaggatctgttcctgcatttgt
atttgttgttaaaattaatggtgggcatttatttgtactaaggctctatgctttacatctactgatatatcatttccatccagtgcatttctc
atataatcatctatatatgtccaacatataggtgttacatcatctatcatacccacttttgcatctgttaatggttgtagccaaaaatggc
tttttgagtttacataggatattacacatccacttaagaacctaattaaactcattccaaaatatgattttcctgtgtttgcaggtccatat
aatactaaacaattttttttaggtataccttttaaaaattttttaaatgcgtctaaaaaggctgtaaattctatgtcttgatatcttaaaaatc
ttactataggcctccaatctccaccatcatctattctatcacatctatactgtatccattgtccaatattcatatgttttcttctgcccgttt
ataatgtctacacatggttgcacagtcctttactattttgcttgcgaattgcttttaggaatgctgcagcattgctatttacatctgcta
actgtgcatatttatatgctatgtcactatcatctgttatatcatgatcatatgcccattgcaccatttctccaaaatcgaatatgctattgt
caaagctatgctgtaatactgtttgttgttctatccattctggggtggtaccatatacctcactaatattagacaaacctgttctatacca
atataatgcacaggtagcacttcgtaattttggtggttctatta<u>CCATATGTGTTTCTGGTATATTTAAC
AGCTGTG</u>ACATTAGTTTGGACACTGTTAATCTGTTTTTTCCACATTTAAACCT
AATTAGCAGCAGTATAAGCACGCCTCTGTCACATGTTAAACATTGCAAATGG
GCATATATGCTATAGGGCTGTATTAATACTTTTAATCCTTCTGCAACTGATGG
TGTTACTCCCATTCCTATAATACACCAATCTGTACAACTACTTCTATTACTTTT
AAATGGTCTTACTAATTCCATAAAGCTAACACCATATGTTTCTTTAAATTTAA
ATAATACAGTTGTTTTATGCTATTTTCGCACATAATATTTTGTATGCTTTTTA
GCGTTCTATTACTATTTTCCTCATTGTCCTCTATACTAGTACAACTTACATCTG
AATTACTAGCCCCCACCCCACTTGATTGACTACTGTTACTTTGCCAGTCGCCA
TTTTGCCCGTCTACCTGGTCTGCCATCTGCTGCGCTTCCACTTCACTATTGCCA
TAGCCGCTGTCTTCTACGTGACATGGTTTGCGTTTTGGTAAAACACACTCTGT
ATTTACACAAATGTGTTTTGCACGCGGACTACCATGTTTTTCTACACCATCTT
GCCCAGCACTTTCCGGACTGCTTGTAAACTTTCGTTTTACTGCAGACACAGCA
TGTAAATCATCCTCCCCTTCCTGTGCATTAAACAATGCCCGGGCTGCCTCATG
TTCTGCCTGTTCATTATTTATATTTGAATCATCTATAAAATCTATTAGATCTGT
TCCACTATCATATGCATTTTCATCCTCGTCCTCTGAAATGTTATCTCCTGTTTG
TTTTTCTATTATTGCCTCTACTTCAAACCAGCCTGTACATCCCTCCCTTTCGCC
CTCTGTACCTTCAGGGTCCTCCATTGCAGGGTTGTTTATAGCCGTGCACAGCC
GGGGCACACAACTTGTAATGTGCCCAACAGCATTTGCTGTAGAGTACGAAGG
TCCGTCGCAGTGCTATGAATGCATAGCCGTAGTGTGCTATCACAACTGTGACA
ATATGTCACAATGTAGTAATTGCTTGTGGCTTGTTCTGCTTGTCCATCTGGCC
GGTCCACACCATCTGTATCCTCCTCATCTGAGCTGTCACCTAATTGCTCATAG
CAGTGTAGGTCAGTTGTTTCAGGTTGCAGATCTAATATATAATCTTTTATAGT
TGCTTTGTCTCCACGCATGACGTTACACTTGGGTCACAGGTCGGGGTCTCCAA
CACTCTGAACAGCGCCCTGTCCAACGACCCATAATATTATGAAATCGCTTGTT

FIG. 3C

TGCATTAACATGTCTTTCTTTTTCTTCAGGACATAATGGCGTTTGACAAATTAT
ACATCTAATAGTTATTTCACTTAATGGTTTTTTACCCTCTCTTCTAATGTTTTC
CCATACAGTGAATATTGATAATGCCTATATTCACTTATCTTAGATAAAAGCG
TAGGCACATAATACACACGCCATATGGATTATTGTCTCTATATACTATTCGTA
AATCTGTAAATAGAAACTTGTATACCTCTCTTCGTTGTAGCTCTTTTTTGCACT
GCACACTGCAGCCTTATTTCATGCACCGATTCTTCCAGCACCTCACACAAT
TCGTGCAGGGTCCGGGGTCGTGTTGCTGGATCCTCAAACATGGCCGTGCGTTA
GCTACACTGTGTTCTATATATACACCGGTTTCGGTCTGACCGTTTTCGGTTA
CACCCTATTTTTACTAGTATAAGATTATAATTTATAATTATAAAAAAAAGTG
GTTGTGGGTACGGTAACCGTAACCGGTCGTGTAGTGCACACCTGGTGAGTAA
CAGTATTTAATCATGTTTTACAAGACATATTTGGCGTAGGATGTACTTGTGTA
AGCCAACACTGTAATTAGTGCATTGAAAGTTTAAATAAAATATGTGCCTAAA
AGCAGTTTAAAACATGCAATGTTAGGCAATGTATTGTTTAGCTGCACTGCAG
GACCTGTGAGTCAGCAAGAAGTCAGTTTAGGCGGGACAACAAGTGTAGACCA
GTGGACTGCAGGAAACCAAAGGATTAAGCAGTTTGCTGAAACTTATATAAAA
ATAGTTGTTACTGTGCCAAGGACAACCAAAGTTGTGCCAAGACCAACCGAAT
TCGGTTAGGATTTAAAATGGTGGATAGTACAAAATGGTACAAAATGGAGAGT
ATAAGGCTAATTAGTAGTGTAACAAAGTAGGACACAGGGTAGGGCAGGGA
CACAGGGTAGGGCAGGAGATGCAATAGATTAGGAGCAACTGTATTGTTACTC
ATGTGGGTGCAACCATAACATAAGACTACTATAAATAGTTTAGTAAATACAG
TACTTTATTAATACATACACAAAACATACATACAGGAACTGACAAATACAAC
AAACATGCACACACATACATAACATGCAAACAACACAGTACACACACAAAA
CAATTACATAACAAACAATGGTTACCTTTTAACCTGTGTTTGACATACACAAC
ACATACATGACACAGACAATTACCCAACAGACAATGGTTACCTTTTAACCTTT
TTCTTCTTTGTGGAGGTACGTGGGGCCGATGATGCAGGGCGTTTTAGTTTGGG
CCTAGCCTGTAGCCCTGCCTGTAACAAAAACTTCCTACCTAAAGGAAACTGA
TCTAAATCTGCAGAAAACTTTTCTTTTAAATCCACCTCCCAAAACATATAGTC
CTTTAAAGGATCTTCCTTTCCTTTAGGTGGTGTGTTTTTTGACAAGTTATAGC
AGTAGAAGTGACAAATCTGTATGTGTCCTCCAAAGATGCAGACGGTGGTGGG
GTAAGGCCAAATTGCCAGTCCTCTAAAATAGTGGCATCCATCTTATGAATGTA
TGTCATAACATCAGCTGTTAATGTAATTTTGCACAATTGAAAAATAAATTGTA
AATCAAATTCCTCGCCATGACGAAGGTATTCCTTAAAATTTTCATTTTTATAT
GTGCTTTCCTTTTAACCTCAGCACATAAAGTCATGTTAGTGCTACGAGTGGT
ATCCACAACTGTGACAAACAACTGATTGCCCAACATATGCCATTATTGTGGC
CCTGCGCACGTTGTAACCAGTACGGTTTATTAAATAATTGGGATTCTGAGGTT
ACCATAGAACCACTAGGAGTAGGAAAAAAGCACTGCTTTGTACAGTGGCAG
TATTGCCAGAGTTAGACCCTTGTATATATAAATCACCTGGCACAGGGTCACCT
AAGGTACCGGCCCTATTAAAAAGTGTCTAACAAACATTTGCTCACGTCTAA
GAAAAAGAACAAACTGTCACCATATGGCTCGCTAGCCATTTGCAAATAATC
TGGATACTTACATACACTGCTACATATCAATGGGCACATCACTTTTACTAG
CTTGCAAGGTATTAAAATCCATGCAACCAAATCCTGTATCTACCATGTCCCCA
TCCTGTATTACACTGTTAATGAGCTGTAGGGGAGGACAATCCCCAGGATTTCC
TGAATTATTATTACAAGGGGTTCCCTTACCCCAATGTTCACCTATAGGAGGTT
TGCATCCTAAAATGCATAACTGAGTCTGCTTATAATCCATAGATAAACATTCC
CTATTATCTATACCAGGTTTACCAGCATATTTGTTACTGGTTTCAGTATCATCA
AACTTGTTTAATAAAGGATGCCCACTAATACCCACACCTAAAGGCTGTCCCCT

FIG. 3D

ACCAATTTCCAAGCCTGTACAGGCCCACACCAACCTTTGGGTTTCTGGGTTAT
AAAAAGATGTATCTGGAAAACCAAATTTATTAGGGTCCGGCAATTTAATTCT
AAATACCCTGTATTGCAGGCCAGACACCTTGGGAACTAAAACTTTTTTACCAT
TACCACTACTGGTGTTTTTAATAGAAAAATAGGGATGTCCTACTGTTAGTAAT
CGAGAACTGCCTGCATAATAATAGATGCTTGTGCGAGACACATACTCATCAG
TGCTTACAACCTTAGAGACAGGTACAGGAGGCAGGTACACAGTGGCCTCACT
AGGCCGCCACACGGACATC

FIG. 4A

HPV56 Deletion Probe Template (SEQ ID NO: 107)

CTGCAAAAAAATAGGGAATACGTTTACGGCGCCTACGTCTAAAAAAATACAC
AGGCCATAATGCAAAGGAGGATCCCTGTATATATACATCATGGGTAACATCA
TAAGGAGACTGAGGAACAAAGGGCCACGTACTGGGGCCTGTAGGCAACACT
ATGTCAGGACCTGAATAAAATGGTGTTTCCCACACATTACCTAAAGGGGCAG
TTACATTAGTGGTGTTACTAGCAAAAGACAATGTGGAAGGCTTTATAGGTAA
GTGTGCAGAAGGTGTAGCAACTGACTGGCTAGACAAACCAGGTGCTTCATCA
TCTATATTTGCATAAATATCATATAGGCCATCAAATGAATTATTTGCAGACAA
TAATGGCTGCATTTCAATTTCCTCAGCCTGTGCAATAGGACTTATATCATAAT
AATAATGCACACGGGCACCTATTTGTGTGCCTCTACGTGTTTGTATAGTAGCC
TTTCTGCCAAGCCTACTAAAACGTACACCACCCCTACGTGTAGTAAATGCAG
GCCTATGTAATGCTACTATATTCATAAAATCAGGGTCAGGAGCCACACCCGA
CGGAGAAAAGCTAAGATGTGTCAGTACCTTCAAAAAGTGGATTATCAGCA
GATACTAATGTTGCAGGTCTATCAAGAAATGCAGGGTCAGTTACCTTAACCT
GCTGAAATGCTTTTCTATATAATCTAGGAGCTGCAATACGCCTAAAGCCTGGA
ATAGGAGTACTACTAATAGGTTCTGTACCAGAACCGTGAACAGCAAATGTTT
GCATAGGTATTTCTTCATAGCTATGTATACCAGATGTGGGTGTGCTAATTAAA
ATATTGCCAGACACCTCGCCTGTTTGTGGGCCTCAATAACAGGGGATCAA
TAAATAACGGATTGGTTATATGGGTACTACTGACATGTACAGTACTAGAGGT
TGGTGTAATATCCAACACGGCAGGTGTAGTTGTTGATGAGGATGTAATTTCA
AATCCCCCAGACCCAGTAAAATTAGGAATCCCTGCACCAGATTCTATAACAC
TGGACTCCTCAACTAATGTAACAATGGAAGGGTCTGTAGGCCCTACGGATTC
CACAACAATAGGTGGTCGCGCCGGAGTTACATCAACTATTGTGGAAGGCCTA
GACCCCAATGGAACATAGCCTGCACGACCCCAGACCCAGTTCCTGTACCAA
TGCCAAGGCCTCCAAAATATGTAAATAAACTTCCCCATTGCAATATTTTATCA
GCCCATGTTTTTGCTCTATTTATTAACAACATCCTCTGGACATGTACCAGAC
AACTTACATGTTTATATAGTTGTGTTGCAGATGCGCGTTTGCGTCGTGTGGC
ACGGTGGGCAACCATAGTAGTAACAGTACTACTACATTTACATATTATTTATT
ATCCACAAAGCATGTAAATATATACACAGCACAGGACAGTAAAAAAATATCA
AAAATATTATAAATGTATTAAAAAAGGATGTGGCTATAACAAACCAAAACAA
TATTATTAATAATATACAACTGGAAAACACAGAGGCAGATAGCAAAAGCGG
GACAACATGACACACAAGCAAACAAACACAAAAGCAAAGCGCAAACACACC
AATAACACAAAAATCAATGGTTGCAATATATATGCGTAGCAGCAATGTATGG
CAGGTACACTTCACGTATTTGTGTGTTACAATAACACAAATGTATATACAATA
TATACAGCACTTTATGGAAAACTCATTTGTCCCAAACTAACCTGTACACTACT
GGGAATTTTTACATGACTTAAAAAGCTGTTTCGTTGTGTTTCATCCTTATATAT
AATTGTAATTATGCTATAATTTTATTGTCTGTACTTGTCCAATGATATGTTGA
TGTTACATCCACAAACAATGTTTTATATTTTTGAAATCGATATCTACAACATT
TTAATCTGTTAGGTTCACCTTTTAAATGTACTACAGGCGTAGTCTTATCACCA
GGGTGGTTGTTGTTGTTGATACTTCTACTTCTACTGTCGGTATTGTCTGTGTCG
CTGATGTGTGTGTGTGTTGTGACACACTTTGCGTGGGACTCTCTGGAGGAGTC
AAATTCTGATTCCCGTAGTCTGGGTCGTTTCCTGGTCTGTG<u>GGATACTGCG
GCGTCTTGGTTGCCCACGG</u>acgtggaggtggtggtggtggtcttgtgggtgttgtattcgttaacagtttcaa

FIG. 4B cagggggatacgttgtatctacaggtactagacacagagtcaggacaataaatactctcatttccatatgtacttcccatatgtttttac
acccaaattttttggcctcttgttcaaagtctgtgtagtatgttttgtggccatcatgtacataatatatacctctatagtctaccccagaa
cacacttttttgccacccacaatctccattgtaatatatatatttccaggctacatattgcatacaattgtttttactaccatcaaaccatac
ttctatatgttgtccttcttttttaaagcatttttaggttcagtaagccatagttcctcgcatgtgtctcttaatgtccactcttcattgttata
tattgttgtacttaatgattccagtgctatttgcacttctattgcactacatgcttttgctttacatacttgtaaacaaggcaccatctggtg
gtttagtacagtaatgtcattttctcttgctttatagtatagcacattttcatgtcgcacagcttccaatattctatatgatctgcaatacat
ctactatcttttcaaaacagtctagtattttgttctggcacgcatttaaacgttgggaaagcgtctccattgttttctttgtcctcgtcgtt
atccaaatttaatctggaccacgtccttgtaaagaaacatttccagtttacattacttaattcatatacaggattaccattattatctaatg
gaaatggattttgaaactgaaacactaacattctactgtgtaaatatcgtaatttagcatctagcataggatttatattggttgtaattag
taatggtggacatttatttgtactaattgtttatgttttctatctaaacttataggatttccatctaccaaattccttaaataatcgtctatat
atttccaacatatttctgttgcatcatccaacaacccaagtttagcattgtctaatggctgcaaccaaaagtggctttgtgaattcaca
aatgaaatgacagacccttgaaaaaactttataagactcatagcaaagcatgatttacctgtatttggcggtccacaaagtaccaaa
cagttatgttaggtgttccttgtagaaataatttaaagtaacttagaaatgaaatgaaatcgaccccttgatatcttaaaaattgtaca
atgggtttccaatcacccccttcatctgttttactacatatgtgctttatccactggcacatattcatttgttgctgttgtgccctttataat
gtctacacattattccacaatccttacatattttgcctgcatattgctttttaaaaaggcttgtgcattgctgtctacatctgctaattgtg
catattgaaacgcaatttggctatcatctgttacttcattatcaaatgcccactgcaccatttagataattcaaattgactatcctgtaa
actgtgttgcaattgtgtttgtctttgtatccattctggtgtgtctccatacacatcactaatatttgacattgctgttttataaaaatataaa
gctacagcaggacttcgtattttggtggttgaattaacatttgctcctgtggtacatttaatattgagcttaatgcttttgcaattgtttttc
tgttttgccacatgtatatctaattagcatcattactataaccccccatgtacatgttaaacattgcatatgataatacatacagtgtgg
ttttattatagttttagtgcctcggctaatgtttcattaacaccaaatatagcacatatccaatcattgcaacatgtactatcactttaaa
cgtacgcaccaattctgaaaatggaataccatacacttctttaaatttataatataatttacc**TTGTAAAATTGCTACTT
TTAAACAAGTCCTG**CAATTGTTGTGTTGGCGTTTCATTGTTTCTATCAATATC
CATATGTATTACAGAGTCCTCACTATTGTTACTATAGGTACTGTTTTGTGAGC
CTCCATTTTGTGTATTCCCGCACCCACGTCCCTGTACCTCTTCATCTACCTGTT
CTGGTGTTTCCAGAGTTTCCAATGTATTGCCATACCCGCTGTCTTGTAGGTCT
GATAAAATAAGCCTCCGTTTTACTCCTTCCCGGCACACAGTTTGCTGATTACT
AATATCCCTTAATGGACTAGCTATATACTTTCGTTTTAGTTTTTGCAACGTCTG
TTTATCTGCATGTGCTGTTTGTACTTGCAACAATTGTTGACTGTTTCTGCGTCT
GCCTGTATATTTTGTATATATGAATCGTCTATAAATCCATCTAAATCTGTATCT
ATTTCATCCTCCTCGTCACTTTCATCATCTGATATTTTATCTCCTGTTTTTTTTT
CTACAATTGCCTCTACTTCAAACCATCCACAACATCCCTTCCCCTCCCCATCT
GTACCTTCAGGTGACGCCATTGCAGTTAGTTACTTGATGCGCAGAGTGGGCA
CGTTACTGTTAACGCACCCATAAGCAGCTGTTGTACAACACGCAGGTCCTCTT
TGGTACTCTGAATGTCCAACTGCACCACAAACTTACACTCACAACAAGGTAC
GTGTATTAGGTAACACGTATGTTGTTTAGCTTGTCTAGCTTGCTGTGGCCGCT
CCTGCAAATGGTCTACTTCATCCTCATCCTCATCCTCTGAGCTGTCCAATTGCT
CATTGCACTGTAGGTCAATTTCTGTTTGAGGTGTTAGTTCTAATACAACGTCT
TGCAGCGTTGGTACTTTACCATGCATGATTATACTGTAGATTCTCTAGGTTCT
CTAGATGTTTGTCTCCAGCACCCCAAACATGACCCGGTCCAACCATGTGCTAT
TAGATGAAATCGTCTTTTCTGTCACAATGCAATTGCTTTTCCTCCGGAGTTA
ACGGACTTTGACATCTGTAGCACCTTATTAATAAATCACATAACTGTTTTTTA
GTTATACTTTCTAGTGTAGCTCCATACACTGAATAGTCATAATACCTATATTTT
CTAACTTTACTATAAAACAATAAACATACTCTGCACACTGCATAAGGAAAAT
CATCCCTATACACTAATTTTAATTCAGTGCATGCAAAATTATATACCTCAGCA
CGTGTTAGTTCTTTTTTGCAATATACACATGATAATCTAAGATCAATTAAAGG
TATTTCTAATACCTCACTCAAGTGGTGCAGGCTTCGTGGACGTTCCTGTGGAT

FIG. 4C

TGTTGAATTGTGGCTCCATGGATATGTCCACACAGAATAAGCTGCCTTTTATA
TGTACCGTTTTCGGTCTTAAACCCTTTTCGGTCACTCCAATATATAAAAGTA
TGATTGAAACTTTCAACAATTAAAAGAAACCTGTTTTGCACGACCGTAAAC
GGTTTTAAAAAATGAGTAATTGTATGTTACATGTTTGCAAAACAGATACTGAC
AGATACTTGGCCTACATAGTGTATTCTGCAAGCCAAAACACCAAAGTTGCAG
ACACATGTATAAAAATGTGTGCCCAACAGCACTAAAGTATGCAGATAAAAGC
ATAGTTGGCAGTCATAGTACCTGTGAGTAATACAGGGTGCGGTACTGTACAT
AATTCAAGTATAAAACACAGGAAACGGCAATATGCCAAAGGATTAACTGTTC
TGCTGAAAAGGGCCTTTTGGTTTAAATAATGGCACTAGGCCATGCAACCGAA
TTCCTTTTAGTTTAAATAATGGCACTAGGCCATGCAACCGAATTCGGTTGCAT
GTACAAAATGGCGGAAAAACAACAAAATGGAGTATGTTATGGTATATATATG
TATGCACAATACACATAGTACACTGTACACAATAACTTACAAAACAAAAGCC
ACAATAATGACACACCTTAGTTTATGCAACCACGCGTAAAAGCACTCATTCA
TGTTTATTACAGACACACAAACATTACACATATATACAGTCATACATACAATG
AATACACACACAAACATTTCACACAAACACAACATACACATACAAAGTATAA
AATAAAGCACATACACAAACATACCATATATACAACACACAAACACAGTTAC
ACAAACACACAACAACACACTACCGCCTTTTACGTTTTGCTGGTGTAGAGGT
GGAGGTAGGAGCAGATCGCTTTTTAGAGGTAGCTACAGCAGGCTTTGACCTA
GTGCCCAGTTGCATTAAAAATTTTCTACCCAGTGGAAATTGATCCAGGTCTGT
AGAAAAACTG<u>TCCTGTAAGTTAACATCCCAAAATTTATAT</u>ttagctaatgggtcctgttt
ttctgttggtggctgttcccgttgacatgttatagctgtgcttctaacatatctatatttatcttctaggctggtggccactggcggggat
aacccaatattccagtcctccagtaggttagcattcatattatgtaaatatgccataacctctgcagacaaagtaattttgcataattga
aaaacaaat<u>TGTAATTCATATTCCTCCACATGTCTAAGG</u>TACTGATTAATTTTTC
GTGCATCATATTTACTTAACTGTTCTGTAGCAGTACTAATAGTCATGTTAGTA
CTTCTAGTAGTATCTACTACAGTAACAAATAATTGATTACCCCAGCAAATGCC
ATTATTATGGCCTTGGGCACGTTGCAACCAATAAGGTTTATTAAATAACTGTG
CCTCAGACGTAATCATAGACCCACTAGGCGTAGCAACATATACAGAACTCGG
AGGGGGTTCTCTACCATTGCTACCCTTTAAATATAACTCTGCAGGTATTGTTT
CCCCAACTTTACCAGCCCTATTAAAATAATGTCTGGCAAATAATTGTTCCCTG
CGTAAGTAAAACCACATAGAATCACCATAGGCATCTGCAGACATTTTTAAAT
AGTCAGGATATTTACAGGTGGATTGTACAATGTCTAAAGGTACCTCAGCCTTA
GATTCCTGCAACACCTTAAAGTCCATAGCGCCAAATCCTGTGTCTATCATGTC
CCCATCCTCTATAGGTGTATTAATTAATGCAAGAGGCGGGCAGTCCCCTGTGG
TAACTTGTGTGGACTTACACAGCACCTTAGTCCAATGTTCACCCATAGCG
GGAGTACATCCAACAATACACAACTGTGTTTGCTTGCCATCAACTGATATATT
GTCCCTACTATCTTCTATAACATTATTATTTGCTAAATTGGAACTTTCAGTATC
ATCCAGCCTATTAAACAATGGATGGCCACTTAGCCCAGCACCTAAAGGCTGT
CCGCGGCCTACCTCCAAACCTACACATGCCCACACTAACCGTTCCTGGTCCGG
ATTATAAATATTAGTATCTGGAAGCCCAAACTTATTAGGGTCGGGCAACCGT
ACCCTAAATACCCTATATTGATATGCACTAACTTTGGGAATGTTTGTTTTGGT
ATTGTCCTTAGTCACAGAGTAATAGGGATGTCCTACGGCAAGCAATCGTGAA
CTGCCTGCATGATAAAATATACTAGTGCGTTTTACATAGGAATCCGTTGCCAC
AACCTTTGAAACAGGTGTTGGAGGTAGATACACCTTATTTTCACTAGGCCGCC
ACGTCGCCATC

FIG. 5A

HPV58 Deletion Probe Template (SEQ ID NO: 108)

TCTGCAAAAAAATATGGAAAACGTTTACGTCTGCGACGCAAAATAAAATAGC
TAGGGTGCAACATAAAATCAGCACCATCCACAATTATGGTATTAAAAGGAGT
TAGTGGAGATATAGGAATAAATGGACTAGACATAGATGTTACAGAAGATGCA
ATGTCTGGACCAGGTTCCAATGACACAAGAGGAGTGTCAAATCCAGTATTTA
ATGGTATGGACACATTACTGGTACGTGTGGTGGCAAAGGACGTATGTGAGTG
CAGAGGACTCTGAAAATCATGTATAGTATCAGCATCGTCAGCATAAATATCA
TAAAGTCCATCATTAATACTATAGGGAGAAACAGAAGTATTTAAAGATTGTA
ATTCAAATTGTTGCTGCTGTTGTACCTGTTCCTGGACAGGCTGTATGGGACTT
AAGTCTTGGTAGTAATGTACTTTAGCCCCTATTTGCTTTCCACTGCGAGTACG
AAGTGTAGCCTTTTGCCCAACCCTACTATAACGTACAGTACCCCTGCGAGAG
GTTAATGCAGGTCTGTGTAATGCAACAATATCTAGAAAATCAGGATCAGGAG
CAGGCGATATGTCACTATGTTGAAACTGCAATGTGTCCTCAGGGTTAAAGCCT
TCAAATGCTGGATTATCATATGTTACAAGTCTATGAGGAGATGTTAAAAAAG
CAGGGTCAACAACCTTAACTTGTTGGGTGTTGCGACTGTATAAACCAAGGCG
TGCCACAGGGCGAGACCCTGGAATGGGTGTGCTAGACGTGACATTGCCACTG
TCAGTAGAAATAACAAAGGTATCCATTGGTATGTTTTCATAACTATGTGTGCT
AACAGTAGGAGAGGAAAATATTAAATGTCCAGAGGCCTCTGCAGGTGCAGG
AGGGCGGAGTACGGATGGCTCAGTAAAGGAGGGATTTAAATGTGTAGAAAC
AGTTTGTATAGATGATTCTCCAATAGAGGAAACATTAAGTATTGCAGGTGTA
GTATCTGCAGAGGTGGTAATATCAAAACCAGATGGAGTGGGAATTGATGGGG
CTGGTGCACCGGCGTCTATAAAACTAGATTCCTCTATTAAAGATACAATAGA
AGAATCCAAAGGCCCCACAGTATCAACGGTAACTGGGGGACGTATGGGCTGT
AAAGGTATAGCCTCAGACGGTGGGGTACTACCAAGGGGCACATATCCAGTCC
TGCCACCTGTACCCGACCCTGTACCAATGCCTAAACCTCCAAAAAACACCCC
TAAGCTACCATATCGTAATATTTGATCTGCTATAGTAGTGCCTTCAACTTTGG
GTATAACATCAGGTGGGCAGGTGCCTGAGGCCTTGCATGTTTGGTAAAGTTG
TGTAGCAGATGCACGCTTGCGCCTTGTAGACCGTTTGTGTCTCATAATAAGAC
AGTGCTAAAAATATAAAAGTATTTATTAGTAAATGTATAAAAATAATAAAAA
CAACACACACAACAGTAAATATTTACAATACCATACCACCATGTGCAGAACC
AGTATACAGTTAGTCTTGTTGGGTTAAGTATTGTGCATGAAAATTAATACACA
TCATTGGTATATATAAAAATATTAAGTAACAGAAAAAATTCGTAGAGCCGA
CCCCACAGACACCCAAAGCAGCAACACCAACACCAGCAACCAAGCATATAT
AGAAATAGATAGCACCAATGGCCGCAAAAAAATGCACAAGCATAAAAACAG
TATAAAACAAACAACAAAATAGGTAATATCATTGTATATACACTTAGCAGC
ACATATTGGCTTGTGGTTTACATACAGTAATTGTACAATACAATTACAATGAC
ATAACACCAGTACTTATTTGCACAGTGGGTGGTATTTTAACAGTGTTTAAAAA
CAGTTGTCGTTGTGTTTCCGTTGTGTATGTTACAGTAACAATTCCTACTTTGTC
ACCTTTGTCATCACTGGTCCAATGCCATGTGGATGACATATTACAGTATAAGT
CTTTAAATGGTTTTAATCTATATCTTAAACATTTTAAACTATTTGGGTCACCTT
TTAAATGCACGATAGGTGAAACTTTAGAACTACACGTTCCGCCCTTTGTAT
GTACAGTTAGTTGTACTGTGTAGTCCTCCTCCTCGTGGTCTACTGTCCACGGC

FIG. 5B

GCAGTCTGTATACTTTGTGGAGTACTGGGTGTTGTCTCTGGAGTCTGGTAAAT
CGAGTCGTCGTCGCTTTGTCCCCTGTGTACTTTCGTTGTTGGTGGCCTCGGTGG
TCTTTGGGTCAGCAGTTTCAGTAGTGGATATTTGATCACTAGGTATAGATGTA
GGACATACAATTACCCGACTACCCACATGTACCTCCCATAATTGTGTTTTAGA
GTACTTTTTTGCATCCTCTTTAAAATATTTAAAATACGTCTTTTCATTGCCATG
TATATAATACAACCCCACATAGTCAACTTCTCCTGCTACCAAAGTACATGTTG
TTTCCTCAATAATATATATTTCACTCCAATTTGTATAATCCATTGTGTTTGCTT
TATCATTGTCATATTGTACAGTTACTGTTATGCCTTTTTTTTAAAGCATTTTT
GTGGCTCTGATAACCACACTTCTAAGCTTGTTTGTTGCAATGTCCATTCATCT
GTTTTATATGGTGATGCATTTAATGTCTCTAATGCCATTTGCAGTTCAATTACT
TGAAACGCTTTAGTCTTTGATGCTACCAATGACGGCACCACCTGGTGGCACA
AATGTGATATTCCCATTTGTCTGGCTGTATACATTATAGCACA<u>CTCCATGCGT
ATTAGTTTCCAATGTTCAAT</u>ttgtgatgttaaatcattttatcagcttcgtatatgtctaggattttgtcctgcact
gcacttaaacgtgctgatatttcctccatcgttttccttgtcctcttcctctattaagcctaatttgcaccacgtccttgagaaaaaggat
ttccaattttcatcatttattttatacactggattaccatttgcatcaaatggaaatggattgttaaattcaaatactgttagtctactgtgc
aaatatggccatcgtgaatctttgcctgcatttgtatttgaggtaattattaatggtggacattttaattgtactaatgccctatgttttaca
tctattgaaatgtcgttaccatctaatgcatttctcatataatcatctatatatgtccagcttatggctgttacatcatctatcatacctagtt
tagcatctgataatggctgcaaccaaaaatgacttttggaatttacatatgaaataatgcatcctttttaaaaaatgtattaaactcattc
caaaatatgatttccctgtatttgctgggccacacagtaacatacaacttttttttggtacaccttgtaaaaactgtttaaatgcaactaa
aaatgctgtaaattcaatattttgatatcttaaaaaattgtactattggtctccaattacctccatcatttgttttttcacacctactttgtatcc
attgtcccattgtcataccacgcttttctgctctttataatgtctgcacataacgccacagtctttactattttgcttgtgcattgcttctt
aaaaatgctgctgcattactattaacatctgctaactgtgcatatttatatgcaatgtcactatcatctgtaatgtcattatcatatgccca
ttgtatcatttcacttaaatcaaatatatcatcattaaagctatgctgtaacactgttaatctatctatccattctggtgttgtcccttgcac
atcacttatatttgacattgctgttctaaaccaatataaggcacatgcttgacttcgtaattttggtggctcgataatcatacatgtttca
ggaattgatagtaaattactcattaattttgccacagttaatctattttttgctacatttaaatctaattaacaataataatataattcctctgt
cacacgttaaacattgtaggtgtgtatatatactgtgctgtttaattagtacttttaaactttctgctacggagggacttattccataccct
gttatacaccaatctgtacagcttgttttatcactttt<u>AAATGGTCTAACTAATTCCATAAAACTTAC</u>
TCCATAAGCTTCTTTGAATTTATATAATAGCGTTGCTTTAGTATTACTGTTATG
TAGAATATTACTAATATTTTGTAATGGAACAGTATTACAACTGTCTACATCCG
TTTCACTGCTTACATCTGAACTAGCCCCACCCCACTAGACTCCGAGTCATTT
AAGTCTGCGTCGCCATTTTGGCTTTCTACCTGGTGTGCCATCTGCTCAGTTTCC
ACTTCAGTATTGCCATATCCGCTGTCTTCTAGCTCAATAATTTTTCGTTTTCTG
TGTGTGCATTCTTTATTTTATATTTCCACGATACACACATTTGCAGCCCGG
TCCACACAGTCCTCTACAGCACTTCTGAGCATGCTGCAAACTTTCGTTTTAG
TGCACACACAGCATTTATATCGTCCACCCCTTCCTGTACATTAAACAACGCTC
GGGCTGCCTCTGCTTCTGCCTGTGTAGTACTTTGTACTGAATCATCTATAAAC
TCTATTAAATCTGTACCACTATCGTCTGCTGTTTCGTCCTCATCATCTGAAATA
TTATCTCCTGTTCTTCGTTCTATTACCGCTTCTACCTCAAACCAGCCAGTACAG
CCCGCCCCTACCCCGTTTGTACCTTCAGGGTCATCCATTGCAGATGGTGTTTA
TTGCTGTGCACAGCTAGGGCACACAATGGTACATGTGCCCATAAGCAGCTGC
TGTAGGGTTCGTACGTCGGTTGTTGTACTGTTGATACACAAACGAACCGTGGT
GCCACAAGTGTAACAACAAGTTACAATGTAGTAATTAGCTGTGGCCGGTTGT
GCTTGTCCATCTGGCCCGTCCAAGCCTATTCATCCTCGTCTGAGCTGTCACA
TAATTGCTCATAGCAGAATAGGTCAGTTGGTTCAGGATGTAAATCTAAAATA
TATTCTCTTAGCGTTGGGTTGTTTCCTCTCATGGCGTTGTTACAGGTTACACTT
GTGTTTGTCTACGTCGGGGTCTCCAACACACTGCACAGCGCCCTGTCCAACGA

FIG. 5C

```
CCCGAAATATTATGAAACCTTTTGTTTAAATCCACATGCCTTTTTTTTCTTGT
GGACACAATGGTCTTTGACAAATAATACATCTAATTAATATTTCATTTAAACA
CTTTTTAGTGTTTGTTCTAATGTGTCTCCATATAGCGAATAATTATAATGTCT
ATACTCACTTATTTTAGATAGCAATCGTAAGCACACTTTACATACTGCAAATG
GATTTCCATCTCTATACACTATTCTTAAATCTGCAAATACAAAGTCATATACC
TCAGATCGCTGCAAAGTCTTTTTGCATTCAACGCATTTCAATTCGATTTCATG
CACAGATGTCTCCAACGCCTGACACAAATCATGCAATGTCCGTGGTTTCTCCT
CTGCGTCCTGGAACATAGTCCTGCAGTAGCCTACCAAAAAATGTCTGCTTTAT
ATATGCACCGGTTTCGGTCAGACCGTTTTCGGTTACACCCTAGTTTTTACAAG
ATTTGGCATTATAGTTTAGTATTATATAAAATGTTGAAACATGAACAATGTGA
CCCAAAACGGTTAGTCCACACCTGGCAATAAATGTTAGTGAGTCACTTTTACA
AGACATAGTTTGGCATAACAAACTATTGTGCAAGCCAAAACTGCACTTAAGC
ATTGAAAGTAAGTTAAAATATGTGCCTATAAGCATGTTTAAACTATGAGTAT
AATTAAACATTTTGCAACTGCACTGCATGTATATATGAGTCACATATGCAAGT
ATAGGCAAAAGCAGTGCAGGAAGGGAAAGGATTAACTGTATTGTTTAAATTG
TAGTTTAAAAAAAACACGTTTGTGCCAGCAACCGAAATCGGTTACATGCACA
AAATGGAGGTAAAGTAAAATGGAGGCAGTACTGTTAAAAACTATAAAATAC
ATATCATACAAATACTATTACATAGGTATGCATAATAGGCAGGGCAGGGTAG
GGCAATTTAGGGACAGCACCTTACTCATAGATACACCCAAACAATACAAATA
GTTTACAATACACAATAGTTTATTACATATATACAGAAACAGGAAACTGA
CAAGGACATAGAACATGTACACAAACATGACACATAACACATACAACATATA
CACAAACATAAACAAACAGACAACACATACATAAAACAAACAAACATGTAT
AATAAAATAGTGTAAGTACCACAACAATTATTTTTTAACCTTTTGCGTTTGG
TGGATGGTGCACGGGTAGTAGGGGCCGAACGTTTAGTCTGGGCTTTGCTTTA
AGGCCTGATTGTAATAAAAACTTTCGTCCCAAAGGAAACTGATCTAGATCCC
CCTCGACTCTAGAGGATCTGCAGAAAACTTTTCCTTTAAGTTAACCTCCCAAA
AAGTATATTTATTTAATGGATCTTCCTTTTCTTTAGGGGGTGCTGTTTTTTGGC
AAGTAATAGCCTGGGAGGTAACAAATCTATATGTGTCCTGTAAACTGGCAGA
CGGAGGAGGTGTTAAACCAAATTGCCAGTCCTCCAAAATATTGGAATCCATA
GTATGTATATGTCATTATCTCTGCAGTTAGTGTAATTTTGCAAAGCTGAAA
AACAAACTGTAAGTCATATTCTTCAACATGACGTACATATTCCTTAAAATTAT
CATTTTTATATGTACCTTCCTTAGTTACTTCAGTGCATAATGTCATATTAGTGC
TACGAGTGGTATCAACCACGGTAACAAATAACTGATTGCCCCAGCAAATGCC
ATTGTTATGACCTTGTGCACGCTGTAGCCAATAAGGCTTATTAAATAATTGTG
ATTCTGAGGTAACTATAGAGCCACTAGGAGTTGGAAAAAATGCACTACTTTG
GATAACTGCAGTATTACCGGACCCTTTAATATAAAGGTCATCCGGGACAGCC
TCGCCAAGTTTTCCAGCCCTATTAAAAAAGTGTCTAACAAACATCTGCTCACG
TCTAAGAAAAAGAACAAACTATCCCCATAAGGTTCACTGGCCATTTTAAA
TAATCTGGATATTTGCATGTACTGTTACAAATATCAATAGGCACATCACTTTT
ATTAGCCTGCAATGTACCAAAGTCCATGCATCCAAACCCTGTATCTACCATGT
CACCATCCTCAATAATAGAATTAAAAAGTTCCAATGGAGGACAATCAGTAGC
AGCTGCATTATTGTTACAGGCAACACCTTTACCCCAATGCTCACCAGTGGGAG
GTTTACAGCCAATTAAACATAATTGTGTTTGTTTATAATCCATAGATAAGCAT
TCCCTGTTATCAGACCCTGGCTGTGCGGATATCTGTTACTGGTTTCAGTGTC
ATCAAATTTATTTAAATAAGGATGACCACTTACGCCAACACCCAATGGCTGTC
CCCTACCTATTTCAAGGCCTACACATGCCCAGACCAAACGTTGTGTATCAGG
```

FIG. 5D

GTTATAAAAGATGTATCAGGAAAACCAAATTTATTGGGATCAGGTAAACGC
ACCCTAAAGACCCTATACTGTAAGCCTGATACCTTGGGAACTAATACTTTTTT
ATTGTTATTGGGACTTTTGATGGAAAAATATGGATTGCCAACAGCCAAAAGT
CTGGAACTGCCAGCATAATAATAAATGCTTGTGCGTGACACATATTCATCAGT
GCTTACAACCTTAGACACAGGCACAGGAGGCAGGTACACAGTGGCCTCACTA
GGCCGCCACACGGACATC

FIG. 6A

HPV66 Deletion Probe Template (SEQ ID NO: 109)

CTGTAAAAAAATAGGGAACACGTTTACGGCGCCTACGTTTAAAAAAATATAC
AGGCCATAGTGCAAATGTACCTCCCTGTATATATACATCATGTGTAACATCAT
AAGGAGACTGAGGTACAAAGGGCCAAGTACTGGGGCCTGTAGGTAAAACTA
TATCAGGACCAGAATAAAATGGTGTTTCCCAAACATTTCCCAAAGGGGCAGT
AACATTAGTTGTGTTACTAGCAAAGGATAATGTAGAAGGTTTAATAGGTAAT
TGTGCAGAAGGTGTAGCACCAGACTGACGAAATGAAATGGGTGCCTCATCAT
CAATATTTGCATAAATATCATATAGGCCATCAAATGGATTGTCTGTAGACAAT
AATGGCTGCATTTCAATTTCATCAGCCTGTGCAATAGGACTTATATCATAATA
ATAATGCACACGAGCACCTATTTGTGTACCCCTACGTGTTTGCATGGTAGCCT
TTTTGCCTAGCCTACTAAAACGCACACCTGTTCTACGTGTAGTAAATGCAGGC
CTATGCAATGCAACTATATCCATAAAATCAGGATCAGGAGCCACACCCGAGG
GAGAAAAGGTCAACGTTGTGTCAGCACCTTCAAAAACAGGATTATCAGCAGT
TATTAATGTTGTGGGGTTGTCCAAAAATGCTGGGTCAGTGACCCTAACCTGCT
GAAAAGCCCTACTATACAATCTGGGAGCAGCAAGGCGTCTAAAACCTGGAAT
AGGGGTACTACTAATAGGTTCGTTGCCAGTACCGTGTATAGCAAATGTTTGCA
TAGGTATTTCCTCATAGCTACGTATTCCAGATGTAGGAGTGCTAATCAAAATA
TTACCAGATACCTCTCCAGTTTGTGGAGCCTCAATTACTGGAGGATCAATATA
TAGTGGGTTTGTTATAGTAGTACTACTTACATGTACAGTACTAGATGTGGGTG
TAATATCCAACACAGCAGGTGTGGTTGTAGAAGAGGATGTGACCTCAAAGCC
CCCTGACCCAGTAAAATTGGGAACACCAGCCCCTGAGTTAATAACACTAGAT
TCTTCTACCAGTGTAACAATAGAAGGATCCGTAGGCCCAACTGACTCCACCA
CAATAGGTGGTCGTGCAGGAGTGACATCAACTATAGTAGAAGGCCTAGAGCC
TAAGGGAACATAGCCCGCCCGACCACCCGACCCAGACCCAGTACCAATGCCA
AGTCCCCCAAAATATGTAAATAAACTTCCCCATTGTAAAATTCTATCAGCCCA
TGTTTTTTGCTCTACCTTATTAATAACATCCTCAGGACATGTACCAGGTAATTT
GCATGTTTTATATAATTGTGTGGCAGATGCGCGTTTGCGTCGTGTGGCACGGT
GGGCAACCATAGTAGCAAAAACGTAATACTGTTACAAATGGTTTATTAACCA
CAAAGCATGAAAATATATACACAGTGTAGGTATATAAAAAAATAGTAAAAA
CAGTATAAATGTATCAAAAAATGATGTAGCCACAACAAACCAAAATAAAGTA
ATTAGTATAAGACAATTGGTAAACAAAGATGCAGATAGCAAAAGCGGGACA
AAATGGCACACACACAGACAAACACAAAAGCAAAGCGCAAACACACAAATT
ACACAAATATCAATGGTTGCAATATATAGCGATTACACGTTACCGTTTCCAGT
GTTACAATAACACATACTATACCAAATACAATTAATGGGTGCAATATATATG
CGTAGCAGCAATGTATGGCAATTACACTTCATATGTATCCGTGTTACAATAAC
ACATATGTATATACAATATATACAACACTTTATGGACAACTCATTTGTCCCAA
AATAACCTGTACACTAGGTGGTATTTTACAACATTTAAAAGGTGTCCCGTT
GCGTTTCATCTTTATATAATATTGTAATAATACTACTGTCTTTATTATCTGTAC
TTGTCCAATGATATGTTGTTGTTACATCTGTAAATAATGTTTTATATTTTTGAA
ATCTGTATCTACAACACTTTAATCTATTGGCTTCACCTTTTAAATGAATTGCA
GGTGTAGTCTTATCACCACAGTGGTTGTGTGTTGATACGTGCACTTCTACT
GTTGGCGTTGTTACTGATGTCTGTGTCTGTTGTGACACGGTGTGCGTAGGACT
CTCTGGAGGAGTCAGGTTCTGATTCACTTGCTCTGGGTCGTTTTCCTGGTCTGT

FIG. 6B

GGGATACCGCGGCGTCTTGGGCGCCCACAGAGGTGGAGGCGGTGGTGGTGGT
CCTGTGGTTGTTGTATTCGTTAACAGTCTCAACAGGGGGTACGTTGTATCTAC
AGGTACTAGACACAGAGTCAGGACAATAAATACTCTCGGTTTCCATATGTAC
TTCCCATATGTTTGTACACCCATATTTTTGGCCTCCTGTTCAAAGTCTGTGTA
ATATGTTTTGTGGCCATCATGCATATAATATATGCCTCTGTAATCCACCCCTG
ATGACACTTTACACCACCCACACTCTCCATTATAATATATAAATTTCCACACC
ACATATTCCATACAATTATTTTTGTTACC<u>ATCAAACCACACTTCTATATGTT</u>
<u>GTCCTTC</u>ttttttaaaacagtttttgggctccgtgcgccacagttcatcacatgtatcacgtaatgtccactcttcatttttatata
ttgtgttacttattgcttccagtgccatttgtaattctattgcactacatgcttttgctttacacacttgtaaagagggcaccatctggtgg
tttagtacattaatgtcatttctcttgctttataatataatacatattcatgtcgtacagctttccaatagtttatatgatctataatgcattta
ctatcttttcataacagtctagtattttgttctggcacgcatctaaacgttgggatagagtctccattgttttctttgtcctcgtcgttatcc
aaatttaatctggaccatgtcctttcaaaaaaacatttccaatttacattactcaattcatacacaggattaccattgttatctaatggaa
atggattttcaaacttaaacactgaaattctactgtgtagatatcctaattttgcatcttgcataggatttacattagttgtaataatgact
ggaggacattttatttgtactaattgtttatgtttcctatctaaacttatgggattcccatctaataaatttcttagataatcatctatatatct
ccaacacgtatctgttgcatcatccagcaaacctaatttggcattgtctagtggctgtaaccaaaagtggcttgtgaattaacaaat
gaaatgactgacccttggaaaaaatttataaggctcatagcaaaacatgatttacctgtatttggtggtccacacagtaccaaacaa
ttatgtttaggcgtgccttgtaaaaataatttaaaataacttaaaaatgaaatgaagtcgacccttgatatcgtaaaaattgcacaat
gggtttccaatcaccaagccaagcttaattcggcttccttcatctactttactacatatgcttatccactggcacatattcatttgct
gttgctgtgccctttttataatgtctacacattattccacaatcctttacatattttgcttgcatattacttttttaaaaatgcttgtgcattacta
tctatgtctgctagttgtgcatataaaaaggcaatttggctatcatctgttacgtcattatcaaatgcccactgtaccattttagacaatt
caaaattgattgtcttgtaaactgtgttgcaattgtgtctgtctttgtatccattctggtgtttccccatacacctcactaatatttgacattg
ctgttttataaaaatataatgccacagcaggacttcgtagttttggtggttgaattaacatttgctcttgtggtacatttaaaattgagctt
agcgatttttgtaattgttttctgtttttttccacatatatatctaattagcatcattacaattaccccccatgaacatgttaggcattgcatat
gatagtacacacattgtggttttagtatagtttttaacgcttctgctaatgtttcattaacaccaaatattgcacatatccaatcgttacaa
catgtactatcgcttttaaatgttcgcaccaactctgtatatggcactccatacacttctttaaatttaaaatgtaatcttccttgtacgtta
ctacttttta<u>AATAGTTCCTGCAATTGGTGTGTTGGTGTTT</u>CCATATTTGTATCTAT
ATCCATATTTACCACCGAGTGCTCACTACAGTTACTGTTTTGCGAGCCTCCAT
TTTGTGAGCTCCCGCACCCATTTCCCTTTTCGTATTCTACCTGTTGTGATGTTT
CCAATGTTTCCAATGTATTGCCGTACCCGCTGTCTTCTGATAATATTAGCCTTC
GTTTTACTTCCTCCCGGTACACAGTTTGCTGATTACTAATATCACTTAAGGGA
CTACCTATATACTTTCGTTTTAGTTTTTGCAACGTCTGTGCATCTGCATGTGCT
GTTTGTACTTGCAATAATTGTTGAGCTGTCTCCCTGTCTTCCTGTGTATTGTTT
ATAAGTGTATTGTCTATAAATCCATCTAAATCTGTATCTGTTTCATTCTCCTCC
TCGCTTTCATCATCTGATATTGTATCCCCGTTTTCTTTCTACAATTGCTTCTA
CCTGAAACCATCCACAACATCCCGTCCCCTCCCCATTTGTACCTTCAGGTGAT
GCCATTGCAGTTATTTAGTTGACGCGCAGAGTGGGCACGTTACTGTTAACGCA
CCCATAAGCAGCTGTTGTACCACACGTAGCTCCTCTTTGGTACTCTGAATGTC
CAACTGCACCACAAGCTCACACTTACAACAAGGTACGTGAATTAGGTAACAC
TTATGTTGTTCAGCTTGTCTAGCTTGCTGTGGCCGCTCCAGCAAATGGTCTATT
TCATCCTCATCCTCATCCTCTGAGCTGTCCAATTGCTCATTGCATTGTAGGTCA
ATTTCAGTTTGCGGTGCAAGTTCTAATATAATCTCTTGCAACGTTGGTGCTTT
ACCATGCATGGTTATACTGTAGATTCTGTGGCTTGTCTACTCGTATGTCTCCA
ACACTGCAAACATGACCCGGTCCATGCATATGCTATATAATGAAATCGTCTTT
TATGTTCACAGTGCAATTGTTTTCCTCCGGTGTTAACGGACATTGACATCGG
TAGCACCTTATTGATAAATCAGATAACTGTTTTTTAGTTATACCTTCTAATGTT
GCCCCATACACTGAATATTTATAGTACCTATATTTTCTAACCTTACTATAAAA

FIG. 6C

CAATAAACATACCCTACATACTGCATATGGCCAATTGTTTCTATATACTAATT
TTAACTCAATACATGCAAACCTATATAACTCTAAACTTGTAAGTTCCTTTTTG
CAGTATACACATGATAATCTAAGATCAAGTAAAGGTATTTGTAATACCTCGCT
CAGATGGTGCAGGCTTCGTGGACGTTCCTGTGTATTGCTGAATATGGAATCCA
TGGATATCTACAGGCACAACAGGCTGCCTTTTATATGTACCGTTTTCGGTCCT
AAACCCATTTCGGTTACTCCAATATAATAAAGTATGATTGAAACTTTCAACA
ATTAAAAGAAACCTGTCTTAGCACGACCGTAAACGGTTTTGAAAAATGAGTA
AGTATATGGTTACATATTTGCAAGACAGATACTTGGCTTATACAATAAGGGCT
ACACGCCAACAAAATATATTGCAAACACCTGCATAAAAACATATGCCCAACA
GCGCCAAAGTATGCAGATAAAAGCATAGTTGGCACAGAAATACTGGTGAGTA
ATACAGGGTAAGGCAGTGTACATACCTGAATCATACAACAGGAAACGGCAAT
ATGCCAAAGGATTAACTGTTTTGCTGAAAAGTCGTTTTGGGTTTAAATAAGGA
CAAAAGGCTAGGCAACCGAATTCGGTTGCATGCATAAAATGGCGTACAGCAC
TAAAATGGAGTTTGGTATGTTACTATAGTGCATACAAACAACCTATTTAATAT
AACAGTAAACAGTAAGGAACACCACCTAACCTGACACACACTGCCCAAGGA
TACTACCGCACCTTAGTTTATGCAACCACGCGTAAAAGTAACCATGCATGTTT
ATTACATACACACAAAACATTACACATACATACAGTCATACATACACATAGC
ACATACACAATTATAAAATACATAAACATACACAAAAACATACAGTACAAGC
ACAACCATACAATACATACAACAGACAACACACAACTATCGTCTTTTACGTTT
AGCTGGTAAAGAAGAGGAAGAGGTAGGAGCCGCCCGCTTTTTAGAGGCAGA
TGCACTAGCCTTGGGTCTAGGGCCTAGTTGCATTAAAAATTTTCTACCCAAAG
GAAACTGATCTAGGTCTGCAGAAAAGCTGTCCTGTAAATTAACCTCCCAAAA
CTTATATTTAGCCAGGGGATCCTGCTTTTCTGCAGGGGCTGTTCCCTTTGAC
ATGTAATAGCTGTGCTTTTAATATGCCTATATTTATCCTCTAAGCTAGTTGCA
ACTGGTGGGGACAATCCAATGTTCCAATCGTCTAATAAAGTATTATTCATATT
ATGCAAATATGCCATAACTTCTGCAGTTAAGGTTATTTTACAAAGTTGAAACA
CAAACTGTAGTTCATATTCCTCCACATGGCGAAGGTATTGATTGATTTCACGT
GCATCATATTTAGTTAATGTGCTTTTAGCTGCATTAATAGTCATGTTGGTACTT
CTGGTAGTATCCACAACAGTAACAAATACCTgattaccccagcatatgccattattatggccctg
tgcacgttgcaaccaataaggtttattaaataattgggcctcagaggtaatcatggacccactaggagtagcaacatatacagaac
tgggaggagggtccctgccattgccacccttccaatacaaatctgtaggaatggcttccccaacattacctgccctattaaagtaat
gtttggcaaacaattgttccctgcgtaagtaaaaccacatagaatccccataggcatctgcagacatttttagataatcaggatattt
acatgtagattgtacaatgtccaatGGCACCTCAGCCTTTGATTCCTGTAATTGCTTAAAG
TCCATTGCACCAAACCCGGTGTCCACCATGTCACCGTCCTCTATTGGGGTATT
AACTAATGCCAAAGGTGGACAATCCCTGTATTGACTGGTGTAGACTTACAC
ACCGCGCCCTTAGTCCAATGTTCACCTAATGCTGGCGCACATCCCACAATACA
TAACTGGGTTTGTTTACAATCAACAGATATATTGTCCCGGTTATCTTCTGCAA
CATTATTACTTGCTAAATTAGAGACTTCAGTGTCATCCAGCCTATTAAATAAT
GGATGACCACTTAACCCAGCACCTAAAGGTTGACCTCGGCCTACCTCCAAAC
CTACACAGGCCCATACCAAACGTTCCTGGTCAGGATTATAGAAAGATGGATC
AGGAAGGCCAAACTTATTAGGATCAGGCAACCGTACCCTAAACACTCTATAC
TGATATGCACTAACTTTAGGGATGTTTGTTTTGGTACCAGATTTAGAAACAGA
GTAATAAGGATGGCCAACAGCAAGCAACCTAGAGCTACCTGCATGATAAAAT
ATACTGGTACGTTTTACATATGTATCCGTTGCCACAACCTTTGAAACAGGTGT
TGGAGGTAGGTACACCTTATTGTCACTAGAACGCCATAGAGCCATC

FIG. 7A

HPV68 Deletion Probe Template (SEQ ID NO: 110)

CTGTAAAAAAATAAGGAAGGTGTTTACGTTTTTTAATAAAAAGAATAACAA
TGGTAATAAATAATAATTGGAACCATATATAGTTATGGCAAAGGTTGTATCA
ATTGGAGTAGAGGGTGTTAAAGGCAACTGTGGGGTTGTAGATGGTAATACAA
CATCAGGACCAGTATTTACAGGCGTGTTCCAAGCAGTACCAAGAGGAATGGT
AGTATTAGTATATGTAGTGGATGCAGCAGAAGCCAATGAAGGAACTGATATG
TGGGAACGAGTAGTAAATGTAGCATTATGAAATGCAGTATCTAATACTGTAG
TATTGTCAGTATCAGGTGCATATATATCATATAAGTTATCCATAGGGTCCGCC
TGCTCAGGGGCAACCAATGGTTGTAGTTCAATGCTGTCAGCAGGGGTAATGT
TACTAATATCATGATAATAGTGCACCTGTGCCCCAATTTGTGTACCTCGGCGT
GTAAACATGGTCGCCTTTTGCCTACTCTGCTAAAACGTACTGTTCCTCTTCG
GGATGTTAAGGCAGGCCTATGTAAACGAACAATGTCCAGAAAATCCGGATCA
GGAGCTATGTCAGCAGGTTCATATGTAAGAGTAGTATCAACAGGCTCAAAAG
CAGGATTATCAAATGTTACAAATGATGAAGGGTGCGTTACAAAATCAAAATT
ACTAACACGAACCTGTTGATGTGCCCTACTATATAAACGTGGCCCTGCCACA
CGACTAACCCCAGGTATAGGAGTACTACTAATAGGTTCTGTACCAGTGCCAT
GTGTTGCAAATACCTGCATAGGTATTTCCTCATATCCATGTGTTCCTGATGTA
GGGGTACTTACAAACACATTACCAGACACCTCACCTGTTTGTGGCACTTCTAT
TATAGTCGGGTCTGTAAATGCAGGGTTAGTAAAACTAGTACTGCTTACCTGCA
CAGACCCGGACGAAGGGGTAATGTCTAAAACTGCCGGTGTAGTGGTAGACGA
AGATGTAATTTCAAACCCAGAGGTGCCTGTAAATGTTGGTACTGGTGTCCCA
GATGTAATAACACTGGAATCCTCCACCAATTGCACAATGGAGGGTTCCGTAG
GACCCACAGGTTCAATAACCACAGGTGGACGTGCAGGCGACACATCCACAAC
AGTATTAGGTTTTCCACCTAAAGGAATGTACCCAGCACGACCTCCGGTGCCA
GAGCCAGTACCTATACCCAGGCCACCCAAAAATATACCTAAACTTGTCCATT
GTAATATTTTGTCTGCAAGTGTAGTACCTTCAACCTTATTTATAACATCAGAA
GGACATGTCCCTGATTGTTTACATGTTTATATAAGTCAGTTGCAGATGCACG
CTTGCGCCTGGCAGCACGGTGTGAAACCATATTTATTTATACAAATAAACAA
CAATACAAATGCACACTATAACAGTTACTGTATAGTATTAAGAGTAAGACTG
TGTAATAACCACATAGGCAGTATAAAAAAAAGTAGGTATACAGCAAACACCT
CAAATGGTGTAGTTCTAACTAATATAAACACAAACACAAATATCCACACATA
CACACACACATGCACAGACTGCAAAAGCGGGACAGTGCAACATATATACAT
GCATACACAAAACCACACCAAAAATACCAATACAAGCATATGTATACAATAT
ACATATAGTGTACAGTGTGGGTCAATACACACTTATAATGTCATATACCCCAA
TGACACAGTTACACTAGATGGTAGTTTAACAGTTTCCAAAAACTTGTCACGTT
GTGCTTCTGAAACATATGTTACAGTCAATATACCTGTATTGGTTGATCCCCTA
CCCCTTATCCAATGCCATGTACATGATATATTGTCATACAAAGCGTTATGTTT
TTGCAACCTATACCTAAGACATTTTAATCCATTTTTGTCACCTTTTAAATGCAC
TATAGGTGTAGTGTCACCACAACAAAGGCTCCGTCTTTTGTTTGGCCTGCAC
TTCTACTGAGGAGTGGGAGGTCGACACCGTCCACGGACACGTTGTCGGGCTC
AGAGGGCTCAGTGATTCCGC<u>ACTGTCTGGGATACTTCCGAGACGACGTC</u>ga
gtttgttttttggtgcatggggcacctgcggtggtatgggtcgcggtggtgttctgtaggtcggcaacagattcagtagtggatact

FIG. 7B tttccgtcagtggtactgcacatagagtcaggacaatggattatgttgccattataatgcacgtcccattttccactagtcccatatag
ttgtgcatcctgcataaacctttcgtaataggtttttgttgttcatacatataatatacaccccagtaatccacacgcccttgggttttac
accatgtgtctgtactgtttttaaagtaaattgtaccccacactacataatgcattgagttactcttgtccccatcataccatacttccac
tgtaacaccatgttttttaaaacattgctttggctttgtatgccatagttcattacttgtgtcccttaatgtccactcctctgcactatatgc
agttttagcaaggctctctagtgccatctgcagttcaatagcttgatatgctttagttttttgaaatgttacaggcggcaccacctggtg
gtcaatattatgcataccacgttctcgtgctgcataatatattgcattttccagtcgcacacaattccaatagttaatatggtcctgtata
catttactgtcctgttcataatgttctaatattttctcctgtaacacatttaaacgttgggaaagtgtttccatcattgtctccttcatcctcg
tcctgctgcaagtctaatctgcaccaagtcttttcaaaaaaacatttccagttttttatcattgattgtatacactgggttcctgttttggtc
aaatggaaatgcattaggaaatttaaacacggttagtctactatgtaaatacggccacctattgtcttctacagggttagtattggatg
ttattagcattggtggacactttatttgtattaggtgtctgtgttttctatctaaacttattgggttaccatctaatgcatttctcatgtaatta
tcaaaatatgaccagcatgtacctgttgcgtcatctagcatggctatttttgcatctgcaagtggctctaaccaaaagtgacttgctg
aatttacatatgaaattattgtgccttgtaaaaaatgtataaggctcatgcaaaaatatgacttgcctgtatttggcggccatgtataa
ctatacaattcgttttggcgtgcctttaaaaaatctttaatgcacataaaaatgttataaattccagtccttgatatcttaaaaattgta
caattgggcgccaatcaccgccttcgtcacatttactgcatctaaatttaatccattgtggcattgtcatttgtcgttttttgcgcccgttt
gtaatgtctacacattgttgcacaatcttttacatattttgcttgacagttgcttttttaaaaacgctgcagcattactattacaatctgctaa
catagcatattgaaatgctatatcactgtcatctgttaactcattatcaaatgcccattgtaccatgtctgataaatcaaatacactatca
tctattccatgttgtattatggttaatcttttatccattccggcgtgtcgccacacacctcactaatattagatattcctgttctataccaa
tataatgctgcaacagggctacgtaattttggtggctgcaaaagcatacagctgtctggaacatgcaacaatgtactcaatccttttc
ctactgttattctattttttccacatttgtatcttattagcattagtattaatattccagttttgtatctaaacattgtatatgggtatacaatg
catattgttaattagtgttttaaaccccttccgcaatggttggattactccaaatattgctgctacccagtctgtacatgtggttttatcac
ttttaaat<u>GTACGTACCAGGTCATTAAATGACAATCCAT</u>ATACTTTTTTAAATTCT
GTTAACATTGCAGCCTTTTTATTGTTACATTGTAATAATACTTTAAGTTGGGTA
GTAGGTGATTTAGGATCCTGGTTTTCACTATCTATAGCACTGTCCACACTACT
ACAGTCCTCCCGTATACTGTCGCCATTTTCCCCTTCATTTTCCCCATCCTCCCC
ATTTATATTAGGTGCTACAGTTACCTCCGAGTTAGTTTCCACTTCCATATTGCC
ATAGCCGCTGTCCGGCACTGTATACGCCGGTTGTCTTGCCTGTGTACTGCTTA
CATTTAGTGATAATTCCTGTAATGGCGACTTTGCTAAAGGACTGCTTTCTATA
CTGTCTGTATACTTTCGTTTTAGGGCACGCACCCTTTGTGCATCCCTTTGGGCC
TCTTGCATATTCAAAAGTACCTGTGCTGTCTCACGCTCTGCCTGTATACAAAT
ATGTGTAGAATCATCAATAAAATCTACCATGTCTGAACCTGTATCTGTTGCGT
TTTCGTCCTCATCCTCTGAGACTGTGTCACCTGTTTGTTTATCTACTATTGCTT
CTACAAAAAACCATCCGTTACACCCCGTCCCGTCCCATCGGTACCTTCACAA
TTGGCCATTGCAGATTACTGGGTTTCAGTTGCACACCACGGACACACAAAATT
TAGTGAGTCCATAAACAGCTGTTGTAGTGTCCGCAGGTTGTCCCGCGACGCTT
CTACTACTAGTTGCAGTGCCTTGTTACACTTACAACACAGACACTGAATTCGA
ATTCTGTGACGCTGTTGTTCGTCCCGTCTGGCTAGTAGTAGATGTTGGTGGTG
ATTAACTGCATGGTCGGGTTCATCTATTTCATCGTCTGAATCTCCTAATTGCTC
GTGACATACAAGGTCAACCGGCTGTATTTCATTGTATGGACATAGCTCTAACA
CAATTTCCTGCACGGTGGGCTTTGGTCCATGCATAGTTACTTAAACTTGTGTT
TCTTGACGTATGCGTCTGCGGTCCTCTCGCTTACTGGTCCAGCAGTGCCGACA
CTGTCCTGTAAAGTTTCCTGCTATTTTATGTAATCTTCGTTTTGTTGTTAGGTG
CCTTAGTTTTTCTGCTGGACACAATGGTTTCAGGCAACTCATGCACCTTATCA
ATAAATTATATAACTTTGTATTAGTTATGGTTTCTAATGTAGTTGCATACACC
GATTCCGAGTAATATCGTAGTTCCCGTATTTAGCATAAAATTTAATACATGA
TTGGCATGCAGCAAATGGTACCCCGTCTCTATACACTACACATAGGTCACTAA
AGGCAAATTCATATACCTCTGTCCGTTGTAGTTGCCTTCTGCAATAGACACAG

FIG. 7C

TCTATTGTAACGTCATGCAATGTAGTGTCCAATGTCCTGCACAGGTCTGGCAA
TTTGTATGGCCGTTCCTCAGGGTTGTGAAATAGCGCCATTAGTATAGAGAACT
GCTGTGTTCAGCTTTATATACACCGTTTTCGGTCGTGACCGTTTTCGGTCCCAC
CCTTTTTTTATATAGAATAATTGTAAATGTTATAAGTAAAAGTATTGGTATG
TGTGCCCAACCTTTTTCGGTTGCACAAATTTATGGATGTAGTATTAGTCACTG
TATAACTTACACTACCAGACAGATTCTTGAATGCAAAAGTAGTTATACTGGCC
AACTATGCTATTAGGCAAGCAAAAACAGTTAAAACTTTATGCCTAAAAGCAG
TTTTATTACAAGGGAGGAGATACGTTGGTTGCCAAACTATTGTTGCAGTGCAC
CTGGACAGGATGATGACTAACTAAGGTGCGCCAGTACGACTGTTACTGGTGC
CAACTATGTGGGTAACTCAAGGTAAAACATGTTTTTGCTGAAACACATAGGT
TTTAATACTATCTAAAAGCAAATAGTACCAACGACCGAAAGCGGTCGCACAC
AACCCGGCCATACAAAATGGCCACACGGTATAGTTTGCAACCATAAATATAT
TGCATATAATGTAACACACCTTAGGGTAGGGCTACAAATTATGTATGAAATG
TTGCAGTCCTATTATATGTAAAACAAGGACATATGTTAGTCACAGGGTGCAA
CCACAAAGGACACGGACATACATACTTTATTAACAAAAACAGATTATACACA
CATACTTGCAAACATACACATATACACATACACATACATGCACATACACAAC
ATACCAACACCAACATGACACATATACAACCACACAGACAAACAACATACA
AAACAAGACATATAACAATTATTTTGACACACGTTTACGTTTGTGTTTAGAGG
TAGATGTGGTAGCTGCAGTGGCAGTGCGTTTACGAGGGCCTATGGTGGGCCG
TCTGCGAACACCTGCCTGTAACAGAAATTTGCGTCCTAATGGGAATTGGTCCA
GTTCAGAACTAAACTTTTCCTTTAAATCCACATTCCAAAAGTTAAGACCATCA
TAGGGATCTTTTTTAACAGGTGCAGGGGCGTCCTTTTGACATGTAATTGCTGC
TGATTGTAGGTAGCGGTATGTATCTACAAGACTAGCAGATGGTGGAGGGGCA
ACACCAAAATTCCAATCATCCAAAATAGCAGGATTCATAGTATGTATATATG
ACATTACATCAGTGGATAATGTTATAGTACACAACTGAAATATAAACTGCAA
ATCATATTCCTCAACATGCCTAACATATTCCTTAAATTTATTAGAATCATACA
CAGCTGGTACAGTAGAGTCTGTAGTAGTGGACAATGTAAAATTAGTACTGCG
CGTTGTATCCACAACGGTAAGAAATAATTGATTATGCCAACAAATACCATTG
TTGTGTCCCTGTGCCTTGTGCAGCCAATAGGGCTTGTTAAATAACTGGGAGTC
AGAGGACACCATAGACCCGCTAGGCGAGGGGGCATACACATAACTACTAGG
AGTTTCACGAATGTCAGTGCCCTTAATATACATGTCAGTGGGAATAGTGTCCC
CT<u>ACCATGCCTCCCCTATTCCAAAAATG</u>cctggcaaataactgttccctacgtaaacaaaaaaaca
tactgtctccatacacatctgcagacatttgcaaatagtcaggatatttgcaaacagattgacatatatccaaaggtacctcgcttttc
gtttcttgtaatgtaccaaagtccatagcaccatatcctgtatcaatcatatcgccatcctcaataggagtatttaccaattccaatgg
gggacagtccccttgttgtacattggtaggcttacaagatttaccttttggccagtgctcgccaatagcaggaacacagcctataat
acacagctgtgtttgtttacagtccactgcaacattgtccctactgtctttaggattttattagaggaaaacggggaattttcagtatc
atccagcctattatatagtggatgcccactaaggccaacgcccaatggctgccccctacct<u>ATTTCAACACCAAC
ACAGGCCCATACCATG</u>CGCTGTGTATCTGGATTATATAATGTAGACTCAGGA
ACACTAAATTTATTAGGATCAGGTAAGGTAACCCTAAACACTCTGTATTGATA
TGCAGACACCTTAGGAATGCCCTGCTTGCGGCCCCAGACATAGGAACCTTA
AAATATGGATGGCCTACAGTTAATAACCTAGATGTACCAGCATAGTAATACA
TGCCAGTGCGTGTCACATAATCATCTGTATTGACAACCTTCGCCACTGAGGGG
GGAGGCAAATACACCATGTTGTCGCTAGCTCGCCACAATGCCAT

FIG. 8A

HPV 26 Deletion Probe Template (SEQ ID NO: 116)

CTGAAAAAAAATAAGGCATACGTTTACGGCGTTTATGGATTAAATAAATATA
GGGCCATAAATAATAATTATCCCCATGCACAACTATTGCAGGTAAGTTAGTG
GTGGGTGGGGGGGCAATGATGGCCATGTCGGGGAAGATGTGGGCGTGTAA
ATGTCTGACCCACTATATACAGGTAGTTCAAATGAGGTGGATAAAGGCACAG
TAACATTGGTAGTGGAAGTATTAATAGAGGAAAACACATTGGAGGCATATCT
TGGAACTGGTAATGTTGTAGGGGAATATGACATGCGCGGCGTATGTATGCTA
GGAACTGTATCAGGGTCTGCATATATCAAACAAGGTGCAGATGAATGGG
TAGATGTATGTAAAGGCTGCAATTCAATTCTTCGTGTTCAGCAAAAGACTGT
ATAGGACTAATATCATGATAATAATGTACTGTAGCTCCAATTTGTTTTCCACT
ACGTGTTTTCATAGTGGCCTTTTGACCCAACCTACTATAGCGTACAGTACCTT
TGCGAGATGTAAGGGCCGGACGATGCAATGCAATAATGTCCAAAAAATCGG
GGTCAGGTGCTACAGTACTACTGGAAGCATATGTAAGTGTTTCATCTATAGGT
TCATATGCAGGATTATCAAAGGTAACAAATGTGGAGGGATTACCAATAAAAT
TGGGATCTGTAACCTTTACCTGTTGATAGGCCTTACTATACAAACGAGGAGCT
GACACTCGTTGTATACCAGGAATAGGTGTACTACTAATAGGTTCTAATCCTGT
TCCATTAGTAGAAGCAAATACTTCCATTGGAATTTCTTCATAACTATGTGTGC
CAGCTGTGGACGTTGTAGTAAATATATGACCTGATGCTTCCCCGGCCTGTGGT
ATATCTATAGGGGGTTCAATATATAATGGATTTTGTATATTGGTACTTGTTAC
ATGTACAGTACCAGCAGAGGGGGTGATGTCCAACACAGCAGGTGTTGTTGCA
GAGGATGTGGTAAGTTCAAAGCCATTGCCACCACTAAATGTAGGTATAGGGG
CTCCAGATTGTATAATACTAGATTCCTCCACCAAAGTAACTATAGAAGGTTCT
GTAGGACCCACAGGTTCAATAATAATGGGCGGACGGGTAGGGCCGATATCCA
CAACAGAGGGTCTACCACCCCTCCTAGGGGAATGTATCCAGTACGCCCACC
AGACCCAGTTCCTGTACCTATACCAAGACCACCTAAAAATATTCCCAAACCA
CTCCATTGTAATATCTTATCAGCAAGGGTAGAACCTTCAATTTTAGGAATAAC
ATCAGGAGGGCACGTACCAGCGGCCTTACATGTTTTGTATAAGTCTGTAGCTG
ATGCTCGTTTGCGTCGAGGGGCACGGACAGCTACCATTGTAACACGTTTATTA
AAGGGACTAAGTAGCAATTACCATTACAGTATAAAAATGTAAAAAACAAGC
AGGTATAAAAAATAAGCAAATATACACAATATAGGTAGTTATATATGATGTA
GATACCACAAACCAAAAACAAAACACTAATAATAGCGAGGCTGCAAACACA
TAAATGGAAAGCAAAAGTGGCAACAAACAACACAGCAACACACACACACAC
ACGCAAAGCACAAACACATAAACTATAAAGGAATAATGATTACAGGTATAT
AGGTGTGTTAGCAGCACATATTGGCTTGTGTGTTGGTAAAATATACACTATAT
TACAATGACATTATTCCCAATGTTGAAGTTATACTTTGTGGTATTTTAACAGT
TGTTAAAAAATTATTACGTTGTGTTATACTGTTAAAGGTAATTGTTACAATGC
CTTGTTGATTGGTATCATTACTGGTCCAATGCCAGGTAGATGATACATTGCAA
TACAATCCTTTATGCTTTTAAATCTATATCTTAAACATTTTAAACTATTTGTA
TCACCTTTTAGGTGTACTATAAACACAGTTTGGTCACTACTCGTGTCCCTTCCC
GGGTGATGGCCTCCACTTGTACTGTGTAGGTTGTTGTTTGTATAGTCCACTGA
CTGTCCGGGCTGTGTGGCAGCTGTGGTGACAGTGGTGACTGTGGTGACGGTG
GTGTCAGGTCCACTGAGTCGTCGTCGCTTTCCTGGGTATGGCGCCTCGGTTTC
CTTGGTGCCCACGGGCACGTAGGCTTCGGTGGTCTGGGTGGTGGCGTTTGATA

FIG. 8B

CTGGCTCAGCAGTTTTAGCAGTGGATATTTGGTTGCTGCTGCAGGTACTAGAT
ACAAATTCAGGACAACAGATTACCTGACCACACACATGTACAGCCCATTGCA
CACCTGTCCCATATTTTTCCGCCTCTTGTTTAAAGTCCACGTAATACTGCTTAT
ATGCCCCTTGTGTATAATATATCCCTTTTGCATCAACATCTCCAGTACCTTTAC
ACCACCCTATATCAGTTTTATAATACACATATTTCCACCTAATATAATCCATT
GTATTTTCCTTATTACAATCAAATACCACTGTTACCGTTGTTCCTTCTTTTTTA
AAACAATGTTTAGGTTCTGTCATATACATTTCATAGCTTGTGTCTCGCATTGTC
CAAGCTTCTGTATTATAGTCCGTGTTATTAA<u>CGACTGCAATGCTATATGTA
TTTCAATTGCCTGCCATGCC</u>tttgtttacacacaacagtagagggcaccacctggtggtttatacattgcat
gtttccttcacgagctttataaaatattgcacattcatatcgtaccagtttccaataatcaatttgatcagttaatttattactgtccagttc
ataatagtctagtattttctcctggcacgcatttaaacgctggcaaaggttctccatttctttgtccgcgtcctcctccaaatctaatct
ggaccaggtggtggaaaaaaagctttccaatttacatcagtcaatgcatatacaggattcccattgctgtcaaatggaaatgtattt
ggaaatggtatcactgttactctactatgtaaatacaaaagtgagttatcttcttgaggatttatatttgaggtaattattaatgggggg
catgtaacttgcagtaggcttctatgttttctgtctatacaacagggatttccatctaaaaagttacgtaaatatttatcaatatataacc
agcagctatatgtagcatcatctaatactgcaacttttgcatcttctaaaggctgcagccaaaaatggctatttgaatttacatatgaa
atgactgacccttgcataaatttataaaactcattgcaaactgtgacttaccagtatttggcggtccatatattactatacaattgtgct
ttgggggtacccttaaaaactgttttaacacttgtaaaaaataaataaagtttacatgttgaaaccttaaaaatttggcaatttccttcca
cgacccgccctcttctatttagaacatctatattgtagccattgtgacatacacatagatcgtttctgtgctcttttataatgtctagtca
tggttgcacagtcttttacatattttgcctgacaattgcttttttaaaaaggcagctgcattactatctatgtcagctaactgtgcatattta
aatgcaatttcactatcatctgttatgtcatgatcgaacgcccattgcaccattttgataaatcaaatgtagcatcatcaaaactatgtt
ctaattgtgtttgtcgtactatccattctggtgtatctccatatgtctcacttatattggacaaccctgttttataaaaatataatgctactg
ctgtacttcgcaatttggtggttcaattagtaattgcgtttctggcacatttaataacatacataggcagttttaattgttgttctgttttt
gcacatgtaaagcgcactagcattagtactattactccccaattacatgttaaacattgtatatgataatataaacaatattgttgtatta
atgatttaatactttctgctacagagcctgccacaccgaatgctgcacacacccaatctgaacagcatgttttgtcacttttaaacac
ccgtactagttctgcaaaacttacaccatatactgttttaaatttacttaacaatgctgcttttacattactacattttaataattcacatatt
t<u>GTGTAACACTGTTTACATGTGTGTC</u>TACATCGATATCTTCCACTGAGGCAT
TTGACCCCCCCTGACTACACACACTAGGCAACCCGCCATTTTCTTCATATTGT
TTATCTACCTGTACGGGCGTAAGAGTTTCCACTTCAGTATAGCCATACCCGCT
GTCCGGTACACTGTCCACGGCTCTCCTTTTGGCCTGTGAATTATTTACTTGGTG
TGTATTCTGCTGACTGTCGCTTTGCTGTCTGTGTTGATTTGTTATGTCTTGCAA
CGGGCTGTTCTGACTACCTAGTAACTTTCGTTTTAAATTGCGCACTGCCTTTGT
ATTTGCCTGTTTTTGTTGTGCCTGAAACAATGCCTGGGTTACCTCCTGTTCTGC
ATAATCACTTATACTACTATCATCTATAAATCCTATTAGGTCCGACCCTGTAT
CACTACTATTGTCTGTTTCATCATCTGATATTGTGTCCCTGTATGTTTTTCCA
CTATAGCTTCTACTGAAAACCACCCTGTACACCCCGCCCCTCCTCATTGTA
CCTTCACAGTCCATTGCAGGTTACTGTGCAGCACACTGATGGCACACCAAG
GACACGTCTTCCATTAACATCTGCTCCAGCACTCGAACGTTCTGTCGACTGCT
CTGCACAGCTAGCTGCACTATACTATTACACATACAACATTGTGCTTCAATTC
TGTAACACACTTCTTGTCCAGCTTGTCTGGCCTGCTGGTCACGCATATTATCT
GTTTCATCCTCATCTGAGCTGTCAAATTGTTCATAGTCCAATTGTTCGTAGCA
GCGTAGGTCAATTTCGGGTTGCGGCACCAGATCTAGTATTACATCTTCAATAT
TAATTATGTTTCCATGCATTGTTCTTTACACTTGTGTTTCTGTTTGGCGCCTTG
GTCTCCAACAATTTGTACACAACCCTTTCCACTGCCCTGCTATTTCGTGAAAT
CGTCGCTTTTCATCCACAATTCTTTGTTTTCTTCTGGCCCAATGGCATTTGA
CATCTATGACACCTTATTAACAAATTACATAAACTTTTTTAGTTAAGGCTTCT
AATGTTGCACCATACACAGAACATGTATAGCGTCTATACTCTGTTATTTTTGA

FIG. 8C

ATAAAATATTACACATCTTTTGCATGCAGCATACGGACTCCTATCTCTATATA
CTACTCTTAGGTCACAAATTGCAAAATTATATACATCAGCCCATTGTAAGGTT
TCCTTGCAATATACACACTGTACCTGCAAATTTTGCAAAGTAGTATTCAAGCT
TTCACATAGCTCATGTAGCGTTCTGGGTCGTTCTCTAGGATCCTCGAACATAG
CTGTTTTGCACGTAGCTAGCCTTTTACTTTTATATGTACCGGTTTCGGTTGCAA
CCGTTTTCGGTTACACCCTTTTAGTAACATATAATTGTTAAAAGTTATTATAA
AGAAACTTGCATGCATTAACAAAACACATTTCGGTTACATACACCTGTGTT
TAACTATGGGTTACAACAGTATGTGTCAGACACATAGTTGGCAAACAAAAGT
GTATATGTTAGCCAACTATGCACTTAAAAGACCTATAAAATAAAATAAAAAT
ATGTGCCTAACAGCAGTTTTATTATAATGTAAGAAAAAGTGCTTATGTAAGTA
TTGTTTAAATATATGTGACTAATACAGGCGCGCCACTTATAGTGCCAAAATGG
CAAGCCAAGCGTAGGAGGCAGGATGTGTTGTCTGCCAAAGGATTAACTGTTC
CTGCAGGATACAGCATGAAAGTTGGATAAAAACTAAAATAAGGAACGACCG
AAAACGGTTGGGACAATAGATAGTAATAGAAAATATAAAAAGTAAAAATAT
AACACTACAAAAGTTTAGTGAAATACATATAAAAGGTAAACTTGTGTAATAT
AATAATTATAAGGGACACCACCTAAGGTTCCTCCCATTACCTCAGGGGTAAA
ACAAATGACAAATAGTGTAGTAAAGACATGTAACCATGCATGAAGACACATT
CATACTTTATTAAATAACAAGTATGCATACAAACAGGAAAACACATAACCAT
GCATACATATAATACATACATACAAAACACGCCTTTACATTACATACAGTTGT
ACACACATACAAACACACCTTACATAACATACCACAAACATATACACACA
CAAACATGCGGAATTATTTAGTAAGTTTACGTTTTTTGCGTTTGGTAGAGGAA
GAGGTAGAAGA<u>TAAGGGACGTTTGGTGCCTAGTTTCGGCCG</u>ccgttgtatgccggc
ctgtaacataaacttacgccctagtggaaattgatccaaatcaatagaaaattttcttttaaatctacatcccaaaattaaaattttgaa
aaggatcttcctttggcacaggaggggcgttacgctgacaggtagtagcagagttttaataaacctataggcatcttccaaacta
gcagtgggaggtaaggttagtccaaaattccaatcctccaatatggaggcattcattaaatgtatgtaagccataacatctgttgtaa
gtgttatttacacaactgaaatataaattgtaattcatattcttcgccatgtcttataaattgtttataatcagatggtttaaatggagtgg
atgcagatgctgcagataatgtactaatggtaaggttagtactgcgggtggtatcaacacaggtaacaaacaattgattgccccaa
cagataccattattatgaccctgtgcacgt<u>TGTAACCAGTATGGCTTATTAAATAGTTGT</u>GCA
TCCGAAGTAACCATAGAGCCACTAGGTGTAGCAGAATAAATAGAAGATGTAG
GGGGCTCCCTGCCTGATTCAGCACCTTTAATATACAAAGTGGTGGGTATAGC
ATCCCCAACAGCCCCCGCCTTATTATAAAAATGTCTGGCAAATAATTGTTCCC
GGCGAAGAAAAAAAACATGCTGTTTCCATATGTATCTGCAGACATTTTAAG
ATAATCAGGATATTTACATGTGGATTGACTAATATCAATGGGCACATCTGATT
TGGTAGCCTGTAAGGCAGTAAAATCCATAGCTCCAAAGCCTGTATCAATCAT
ATCGCCATCCTCAATAATGCTGGAAATTAATTCTAAGGGGGGGCAATCCCCA
CGTTGTGTCTGTGTATTTTACATATAGTGCCAATACCCCAGTGCTCTCCCAA
GGGCGGTGTACAACCTATAATACATAACTGTGTTTGTTTATTATCAACTGAAA
CATTGTCCCTGTTGTCAGTGTCTGCATTTACAGTAGCCAAATGAGAGTTTCG
GTATCATCCAACTTATTAAACAAGGATGTCCACTAAGGCCAATGCCTAATG
GCTGTCCTCTACCAACTTCAACACCAACACAGGCCCACACCAGGCGTTCTGT
GTCAGGATTATATAACTGTGGATCAGGCAATCCAAATTTATTAGGATCAGGT
AGGTGCACTCTAAATACCCTGTACTGATAGGCAGATACCTTAGGAATTTCGG
CCTTTTGGCCAGTTTTAGGTATGGAAAAATATGGATGTCCTAATGTTAATAAA
CGAGAGCTGCCCGCATAATAATATATGCCGGTGCGAGTTACATATTCATCCGT
GTTGACAACCCGAGACACAGGGGTGGGAGGAAGATATACCTTGCTGTCACTA
GTACGCCACAAAGCCATC

FIG. 9A

HPV73 Deletion Probe Template (SEQ ID NO: 16):

CAGACGACTGTGAAATAGCATATAAATATGCATTATTAGGCAATGTAGACAG
TAATGCAGCTGCATTTTTAAAAAGTAATGCACAAGCAAAATATGTAAAAGAC
TGTGGTACAATGTGCAGACATTATAAAGCAGCAGAACGTAAACAAATGTCAA
TGGCACAATGGATACAACATAGATGTGATTTAACTAATGATGGTGGTAATTG
GAAAGATATTGTGCTATTCCTAAGATATCAAAATGTAGAATTTATGCCTTTTT
TAATTACATTAAAACAATTTTTAAAAGGTATTCCCAAACAAACTGTATAGTA
TTATATGGACCGCCAGATACAGGAAAATCACATTTTGGAATGAGTTTAATTA
AATTTATACAAGGTGTAGTTATTTCGTATGTAAATTCAACTAGTCATTTTGG
TTATCACCCTTAGCTGATGCAAAAATGGCATTATTAGATGATGCAACACCTGG
ATGCTGGACGTACATAGACAAATATTTAAGAAATGCATTAGATGGTAATCCT
ATATGTTTAGATAGAAAACATAAAAATTTATTACAAGTTAAATGCCCTCCATT
ACTGATAACATCAAATACAAATCCTAAAGCAGATGATACTTGGAAATATTTA
CATAGTAGAATTAAGGTGTTTACTTTTTTAAATCCATTTCCATTTGACAGTAA
TGGGAACCCACTATACCAACTTACTAATGAAAACTGGAAAGCATTTTTTACA
AAAACGTGGTCAAAACTAGATTTAACAGAGGACGACGACAAGGAAAATGAT
GGAGACACTGTGCAAACGTTTAAGTGCGTGTCAGGACGCAATCCTAGAACTG
TATGAACGTGACAGTGTACACCTAAGTGATCATATTGATCATTGGAAACACG
TGCGACATGAAAATGTATTATTACATAAAGCACGTGAAATGGGACTGCAAAC
TGTTAACAATCAAGCGGTGCCAAGCCTTGCAGTATCACGATCCAAAGGGTAT
AATGCAATTGAAATGCAAATAGCACTAGAAAGTTTAAATGAATCTTTGTATA
ACACAGAGGAATGGACATTGCAACATACAAGTTGGGAACTGTGGGTTACAGA
ACCTAAACAATGTTTTAAAAAGGATGGAAAAACAGTAGAGGTTAGATATGAC
TGTGAAAAGGACAATAGCATGCAATATGTATTTTGGACACATATATATTGTTG
GTATGAAGGGGGGTGGGCAAAGGTAGGTAGCAAAATAGATTATAATGGTAT
ATATTATGAAACAGATGATGAGGAAAAGGTATACTATACAAGATTTGATACA
GATGCAAAACGGTACGGGGTAAAAGGCATATGGGAAGTACATATGGGTGGT
CAGGTAATATGTTGTGCTCCTGTATCTAGCGCCTGTGAAGTATCCATTCCTGA
AATTGTTAACCCACTGCACACCACAACCACCAACACCACCACCACCTGCACC
AACGTTGACACCGGTGTGCCATCACGGAAACGGCAAAGACAGTGTGACTCGG
ACCAGAGGCCCCTGGATTGTTTGCATAACCTACATCCCACCACAGAGTCCTGT
ACCCAGTGTACTACACATAATGTTGCGCCAATAGTGCATTTAAAAGGTGACA
AAAACAGCTTAAAATGTTTAGATATAGATTGCATAAAGGCTATTCACATTTA
TTTAAAAATGTAACAACAACATGGCATTGGACCAATACTACAAATAGTAAAT
GTGGTGTAATAACATTAATGTTTACAACTGTATTGCAACAACAACATTTTTTA
CAACATGTAAAAATACCACAAACTATTGTAGTTACATCAGGATACATGTCTTT
GTAACATTGGTTACACAGTATATATGATTCTTTGTATATTTGTATTTTTGTTTT
GTGTTGGCTTTTGTTTGTGCTTGTGTGTCGCTTGCAGTGTCTGTGTATATTT
ACCCATGGTTATTGGTATTGATTATAATAACCTTTATACATGTATCACAATCA
TTGTTAAAAGTATTTTTTTATATGTTTTGGTATTTTATATTCCTATGGCACTT
GTACATTACCATGCTACATTACAAATAACATAAACAATTTTACATATATAATA
AACTGCCTAATATTTTTAGTGTACCATGCGTCGCAAGCGTGACACACACATAC
GAAAAAAACGTGCATCTGCAACACAATTATATAAAACATGTAAACAAGCAG

FIG. 9B

```
GTACGTGCCCTCCTGATGTAATTCCCAAGGTTGAAGGTAGTACTATAGCTGAT
AATATATTAAAATATGGTAGTATTGGAGTTTTTTTGGGGGATTGGGAATAGG
TAGTGGGTCTGGATCAGGGGGGCGTACTGGATACGTTCCATTATCTACAGGC
ACACCATCTAAACCAGTTGAAATTCCATTACAACCTATACGACCATCAGTTGT
TACGTCTGTTGGGCCTTCAGATTCTTCTATTGTTTCATTAGTGGAAGAATCAA
GTTTTATAGAGTCAGGTATACCTGGTCCTACATCTATAGTGCCTTCTACTTCA
GGGTTTGATATTACAACTTCTGTAAACAGTACACCTGCTATTATAGATGTATC
TGCTATTAGTGATACTACACAAATATCTGTTACAACATTTAAAAATCCAACCT
TTACTGACCCATCTGTGTTGCAACCTCCTCCACCCTTAGAAGCCTCTGGCAGA
CTTTTATTTTCAAATGACACTGTAACTACCCATTCATATGAAAATATACCTCTT
GACACATTTGTAGTTACAACAGACCACAATAGTATTGTTAGTAGTACGCCCAT
CCCAGGGAGGCAACCTGCTGCACGCTTAGGATTATATGGACGTGCAATACAA
CAGGTTAAGGTTGTAGACCCTGCGTTTTTAACTACGCCTACACGTTTAGTAAC
ATATGACAACCCTGCCTTTGAAGGCCTGCAGGATACAACATTAGAGTTTCAG
CACAGTGACTTGCATAATGCTCCTGATTCTGATTTTTAGATATTGTAAAATT
ACATAGGCCTGCTTTAACCTCTAGAAAAACAGGCATACGTGTTAGTAGATTG
GGACAACGTGCAACACTTTCTACTAGAAGTGGCAAACGTATAGGTGCTAAAG
TACATTTTTATCATGATATAAGTCCTATACCTACTAATGATATTGAAATGCAA
CCTTTAGTTACACCACAAACACCTAGTATAGTAACTGGTAGTAGTATTAATGA
TGGGTTATATGATGTGTTTTAGACAATGATGTAGAAGAGACTGTACTACAAC
AAACATATACACCTACAAGTATACATAGTAATAGTTTAGTTAGTAGTGATATT
TCTACTGCAACTGCAAATACAACTATTCCTTTTAGTACTGGGTTAGACACACA
TCCTGGTCCAGATATTGCTTTACCACTACCTTCTACAGAAACTATTTTTACACC
AATAGTGCCATTACAGCCTGCTGGTCCTATATATATTTATGGGTCAGGTTTTA
TATTACACCCTAGTTATTATTTGTTAAAGCGCAAACGTAAACGTCTGTCATAT
TCTTTTACAGGCGGCCGCCACCGCGGTGGAGCTCCAATTCGCCCTATAGTGA
GTCGTATTACGCGCGCTCACTGGCCGTCGTTTTACAACGTCGTGACTGGGAAA
ACCCTGGCGTTACCCAACTTAATCGCCTTGCAGCACATCCCCCTTTCGCCAGC
TGGCGTAATAGCGAAGAGGCCCGCACCGATCGCCCTTCCCAACAGTTGCGCA
GCCTGAATGGCGAATGGGACGCGCCCTGTAGCGGCGCATTAAGCGCGGCGG
GTGTGGTGGTTACGCGCAGCGTGACCGCTACACTTGCCAGCGCCCTAGCGCC
CGCTCCTTTCGCTTTCTTCCCTTCCTTTCTCGCCACGTTCGCCGGCTTTCCCCG
TCAAGCTCTAAATCGGGGGCTCCCTTTAGGGTTCCGATTTAGTGCTTTACGGC
ACCTCGACCCCAAAAAACTTGATTAGGGTGATGGTTCACGTAGTGGGCCATC
GCCCTGATAGACGGTTTTTCGCCCTTTGACGTTGGAGTCCACGTTCTTTAATA
GTGGACTCTTGTTCCAAACTGGAACAACACTCAACCCTATCTCGGTCTATTCT
TTTGATTTATAAGGGATTTTGCCGATTTCGGCCTATTGGTTAAAAAATGAGCT
GATTTAACAAAAATTTAACGCGAATTTTAACAAAATATTAACGCTTACAATTT
AGGTGGCACTTTTCGGGGAAATGTGCGCGGAACCCCTATTTGTTTATTTTTCT
AAATACATTCAAATATGTATCCGCTCATGAGACAATAACCCTGATAAATGCTT
CAATAATATTGAAAAGGAAGAGTATGAGTATTCAACATTTCCGTGTCGCCC
TTATTCCCTTTTTTGCGGCATTTTGCCTTCCTGTTTTTGCTCACCCAGAAACGC
TGGTGAAAGTAAAAGATGCTGAAGATCAGTTGGGTGCACGAGTGGGTTACAT
CGAACTGGATCTCAACAGCGGTAAGATCCTTGAGAGTTTTCGCCCCGAAGAA
CGTTTTCCAATGATGAGCACTTTTAAAGTTCTGCTATGTGGCGCGGTATTATC
CCGTATTGACGCCGGGCAAGAGCAACTCGGTCGCCGCATACACTATTCTCAG
```

FIG. 9C

```
AATGACTTGGTTGAGTACTCACCAGTCACAGAAAAGCATCTTACGGATGGCA
TGACAGTAAGAGAATTATGCAGTGCTGCCATAACCATGAGTGATAACACTGC
GGCCAACTTACTTCTGACAACGATCGGAGGACCGAAGGAGCTAACCGCTTTT
TTGCACAACATGGGGGATCATGTAACTCGCCTTGATCGTTGGGAACCGGAGC
TGAATGAAGCCATACCAAACGACGAGCGTGACACCACGATGCCTGTAGCAAT
GGCAACAACGTTGCGCAAACTATTAACTGGCGAACTACTTACTCTAGCTTCCC
GGCAACAATTAATAGACTGGATGGAGGCGGATAAAGTTGCAGGACCACTTCT
GCGCTCGGCCCTTCCGGCTGGCTGGTTTATTGCTGATAAATCTGGAGCCGGTG
AGCGTGGGTCTCGCGGTATCATTGCAGCACTGGGGCCAGATGGTAAGCCCTC
CCGTATCGTAGTTATCTACACGACGGGGAGTCAGGCAACTATGGATGAACGA
AATAGACAGATCGCTGAGATAGGTGCCTCACTGATTAAGCATTGGTAACTGT
CAGACCAAGTTTACTCATATATACTTTAGATTGATTTAAAACTTCATTTTTAAT
TTAAAAGGATCTAGGTGAAGATCCTTTTTGATAATCTCATGACCAAAATCCCT
TAACGTGAGTTTTCGTTCCACTGAGCGTCAGACCCCGTAGAAAAGATCAAAG
GATCTTCTTGAGATCCTTTTTTTCTGCGCGTAATCTGCTGCTTGCAAACAAAA
AAACCACCGCTACCAGCGGTGGTTTGTTTGCCGGATCAAGAGCTACCAACTC
TTTTTCCGAAGGTAACTGGCTTCAGCAGAGCGCAGATACCAAATACTGTTCTT
CTAGTGTAGCCGTAGTTAGGCCACCACTTCAAGAACTCTGTAGCACCGCCTA
CATACCTCGCTCTGCTAATCCTGTTACCAGTGGCTGCTGCCAGTGGCGATAAG
TCGTGTCTTACCGGGTTGGACTCAAGACGATAGTTACCGGATAAGGCGCAGC
GGTCGGGCTGAACGGGGGGTTCGTGCACACAGCCCAGCTTGGAGCGAACGA
CCTACACCGAACTGAGATACCTACAGCGTGAGCTATGAGAAAGCGCCACGCT
TCCCGAAGGGAGAAAGGCGGACAGGTATCCGGTAAGCGGCAGGGTCGGAAC
AGGAGAGCGCACGAGGGAGCTTCCAGGGGGAAACGCCTGGTATCTTTATAGT
CCTGTCGGGTTTCGCCACCTCTGACTTGAGCGTCGATTTTTGTGATGCTCGTC
AGGGGGGCGGAGCCTATGGAAAAACGCCAGCAACGCGGCCTTTTTACGGTTC
CTGGCCTTTTGCTGGCCTTTTGCTCACATGTTCTTTCCTGCGTTATCCCCTGAT
TCTGTGGATAACCGTATTACCGCCTTTGAGTGAGCTGATACCGCTCGCCGCAG
CCGAACGACCGAGCGCAGCGAGTCAGTGAGCGAGGAAGCGGAAGAGCGCCC
AATACGCAAACCGCCTCTCCCCGCGCGTTGGCCGATTCATTAATGCAGCTGG
CACGACAGGTTTCCCGACTGGAAAGCGGGCAGTGAGCGCAACGCAATTAATG
TGAGTTAGCTCACTCATTAGGCACCCCAGGCTTTACACTTTATGCTCCCGGCT
CGTATGTTGTGTGGAATTGTGAGCGGATAACAATTTCACACAGGAAACAGCT
ATGACCATGATTACGCCAAGCGCGCAATTAACCCTCACTAAAGGGAACAAAA
GCTGGGTACCGGGCCCCCCTCGAGATGTGGCGACCTACTGATGCAAAGGTA
TACCTGCCCCTGTGTCTGTGTCTAAGGTTGTAAGCACAGATGAATATGTAAC
AAGAACAAATATATATTATTATGCAGGTAGCACACGTTTGTTGGCTGTGGGA
CACCCATATTTTCCTATCAAGGATTCTCAAAAACGTAAAACCATAGTTCCTAA
AGTTTCAGGTTTGCAATACAGGGTGTTTAGGCTTCGTTTACCAGATCCTAATA
AATTTGGATTTCCAGATGCATCCTTTTATAATCCTGATAAGGAGCGCCTAGTA
TGGGCCTGTTCTGGTGTGGAGGTTGGACGTGGACAACCCTTAGGTATAGGTA
CTAGTGGCAATCCATTTATGAATAAATTAGATGATACTGAAAATGCTCCTAA
ATACATTGCTGGACAAAATACAGATGGTAGAGAATGTATGTCAGTGGATTAT
AAACAAACACAGTTGTGTATTTTAGGTTGTAGGCCTCCCTTAGGGGAACATTG
GGGTCCAGGCACGCCATGTACTTCACAAACTGTTAATACTGGTGATTGTCCCC
CACTGGAATTAAAGAACACCCTATACAGGATGGTGATATGATAGATGTTGG
```

FIG. 9D

CTTTGGAGCCATGGATTTTAAAGCTTTACAAGCAAATAAAAGTGATGTACCT
ATTGATATTTCTAACACTACCTGTAAATACCCAGATTATTTAGGCATGGCTGC
TGATCCCTATGGTGATTCCATGTGGTTTTATCTTCGTAGGGAACAAATGTTTG
TTCGACACTTATTTAACAGGGCTGGTGATACCGGTGATAAAATCCCAGATGA
CCTAATGATTAAAGGCACAGGCAATACTGCAACACCATCCAGTTGTGTTTTT
ATCCTACACCTAGTGGTTCCATGGTTTCTTCAGATGCACAGTTGTTTAATAAA
CCTTATTGGTTGCAAAAGGCACAGGGACAAATAATGGTATTTGTTGGCATA
ATCAATTATTTTTAACTGTTGTAGATACTACTAGAAGCACTAATTTTCTGTAT
GTGTAGGTACACAGGCTAGTAGCTCTACTACAACGTATGCCAACTCTAATTTT
AAGGAATATTTAAGACATGCAGAAGAGTTTGATTTACAGTTTGTTTTCAGTT
ATGTAAAATTAGTTTAACTACTGAGGTAATGACATATATACATTCTATGAATT
CTACTATATTGGAAGAGTGGAATTTGGTCTTACCCCACCACCGTCAGGTACT
TTAGAGGAAACATATAGATATGTAACATCACAGGCTATTAGTTGCCAACGTC
CTCAACCTCCTAAAGAAACAGAGGACCCATATGCCAAGCTATCCTTTTGGGA
TGTAGATCTTAAGGAAAAGTTTTCTGCAGAATTAGACCAGTTTCCTTTGGGAA
GAAAATTTTATTACAACTTGGTATGCGTGCACGTCCTAAGTTACAAGCTTCT
AAACGTTCTGCATCTGCTACCACAAGTGCCACACCTAAGAAAAACGTGCTA
AACGTATTTAATAAGTGTAATGTGTATGTGTTGTTTGTTGTATGTTACATGTGT
TTTGTATGTTTGTTTGTTGTATGTTAACTGTTTACTAATACTGTGTGTATGTTT
ATGTACATGTGTATAACTGTTTGTTTATATATATGTATGTATTTGTGTGTATGT
GTATGTGTATGTGTATGTGTAGTAATGTTTGTATGTATGTTTAATAAAGTTTAT
ATGTGTGTTGTGTGGGTGGTTTACTTGACTACTGTGCTTCCATTTGTATAGTC
GCCATTTTACATGCATTAAGGTAAAAAGGGCAACCGATTTCGGTTGCACAGT
AAAACATGTTTTAATGTGTTTTGCTGTTGTAGCAAAATAGTTGTACTGTTTTG
GCTTCCTGCAGGCAACTTGGCAGGGTTTGTTTCCTTAACATGTTCATCCCACG
CAAGGTTATAAAGGTAAAAGGCGCCACCTGGCAGTTACTCATTTGTCTGCAA
TTATTTAAACAATGTCTTGCACACACATTTTTACCCACCCTATCATAAAATT
GCTTTTAAGCACATACCTATACTATGTACACAGTGTACTCTTGGCAGAACATT
GTTTTTTAAATGCCAAGTAATTGTTTTATAAATGAGTAATAACGTGTTACTCA
TACTGCACCTAAAAAGTTAAACCTATTTGGATCACACAAATGCCAATTTATTT
CTTATTACAAATAACTATAATGTACTATTAAAAAAAGGGTGTAACCGAAAA
CGGTTTCAACCGAAATCGGTGCATATAAAAGTAGGAAAGCAAAAAACGCTAC
AGATTGGGAAATGCTGTTTCCCAATTCAGAAGAACGACCATACAAGCTACAA
GCGTTATGTGACGAAGTGAATATTTCTATACATGATATAAACCTGGACTGTGT
GTTTTGCCAACGTGGACTGTACAGATCTGAGGTATATGATTTTGCATTTAGTG
ATTTGTGTATTGTATATAGAAAGGATAAACCATATGGTGTATGTCAACCGTGT
TTAAAATTTTATTCTAAAATTAGAGAGTATAGGCGATATAGACAATCAGTAT
ATGGCACTACGTTAGAAAATTTAACTAACAAACAGTTATGTAATATTTTAATA
AGGTGCGGAAAATGCCAAAAACCATTATGTCCACTGGAAAAGCAAAGCAT
GTAGATGAAAAAAACGGTTTCATCAAATAGCAGAACAGTGGACCGGACGC
TGTACACGGTGCTGGAGACCATCTGCAACTGTGGTGTAAGATGCATGGAAAA
AAAACAACCTTGCAGGACATTACTTAGACCTGAAACCAACAACCGAAATTG
ACCTTACATGTTACGAGTCATTGGACAACTCAGAGGATGAGGATGAAACAGA
CAGCCATCTAGACAGACAAGCTGAACGAGAGTGTTACAGAATAGTTACTGAC
TGCACGAAGTGTCAGTGCACAGTATGCCTTGCCATTGAAAGCAACAAAGCTG
ATTAAGAGTGATAGAAGAGTTGCTTATGGGTACACTAGGTATTGTGTGCCCC

FIG. 9E

```
AACTGTTCCAGAAACCTATAAAAGAAGATGGCTGATTCAGGTAATTGGGAAG
GGAGGTGTACGGGATGGTTTAATGTAGAAGCCATTGTAGAAAGAAAAACAG
GGGATCCAATTCCAGAGGATGAAAATTATGATGGAGGGGATACAGATGAGTC
GGAAATGGGGGATTTTATTGATAATGCACATATACCAAATATATATGCACAA
CAGGAAATTGCACAGGCATTGTATCAGTCACAGCAAGCAAATGCAGACAATG
AGGCTATACGTGTTCTAAAACGAAAGTTTACAGGTAGTCCTGGCGGTAGCCC
AGATATGAAAGAGATGAATTCATAGACAAACAGCTTAGTCCACAAATAAAT
GTATTGTCAATAAGTAGCGGTAGAAGTACATCTAAACGAAGACTGTTTGAGG
AGCAGGACAGTGGATATGGCAATACTGAAGTGGAAACTTACGAGACAGAGG
TACCGGGACTTGGGGCAGGGGTAGGGTGTTTACAAAATGTTAATGAAGAAGG
CAACCAAATTGTGTCGCCACGTGAAAGCAGTAGTGGGTCCAGTAGCATTTCA
AATATGGATATAGAAACAGAGAGCACACCTATAACAGATATTACAAATTTAT
TACAAAGGAATAATGCAAAAGCAGCATTGCTAGCAAAATTTAAAGAAGTATA
TGGGTTAAGTTATATGGAATTAGTTAGACCATATAAAAGTGATAAAACACAT
TGCCAAGATTGGGTGTGTGCTGTGTTTGGTGTAATACCCTCACTTGCAGAAAG
TTTAAAATCCTTACTAACACAGTATTGTATGTATACATTTGCAGTGTTTAA
CATGTACATGGGGCATAATAGTGTTAGTATTAGTAAGATTTAAGTGCAATAA
AAATAGACTAACAGTGCAAAAATTATTAAGTAGTTTATTAAATGTAACACAA
GAACGCATGTTAATTGAACCTCCAAGACTACGAAGTACACCATGTGCATTAT
ATTGGTATAGAACTAGTTTATCAAATATTAGTGAAATAGTAGGAGACACACC
TGAGTGGATTAAAAGACAAACGTTAGTGCAGCATAGTTTAGATGATAGTCAA
TTTGACCTATCTCAAATGATACAGTGGGCATTTGATAATGATATAACAGACG
ACTGTGAAATAGCATATAAATATGCATTATTAGGCAATGTAGACAGTAATGC
AGCTGCATTTTTAAAAAGTAATGCACAAGCAAAATATGTAAAAGACTGTGGT
ACAATGTGCAGACATTATAAAGCAGCAGAACGTAAACAAATGTCAATGGCAC
AATGGATACAACATAGATGTGATTTAACTAATGATGGTGGTAATTGGAAAGA
TATTGTGCTATTCCTAAGATATCAAAATGTAGAATTTATGCCTTTTTAATTAC
ATTAAAACAATTTTTAAAAGGTATTCCCAAACAAACTGTATAGTATTATATG
GACCGCCAGATACAGGAAAATCACATTTTGGAATGAGTTTAATTAAATTTAT
ACAAGGTGTAGTTATTTCGTATGTAAATTCAACTAGTCATTTGGTATCACCC
TTA
```

FIG. 10A

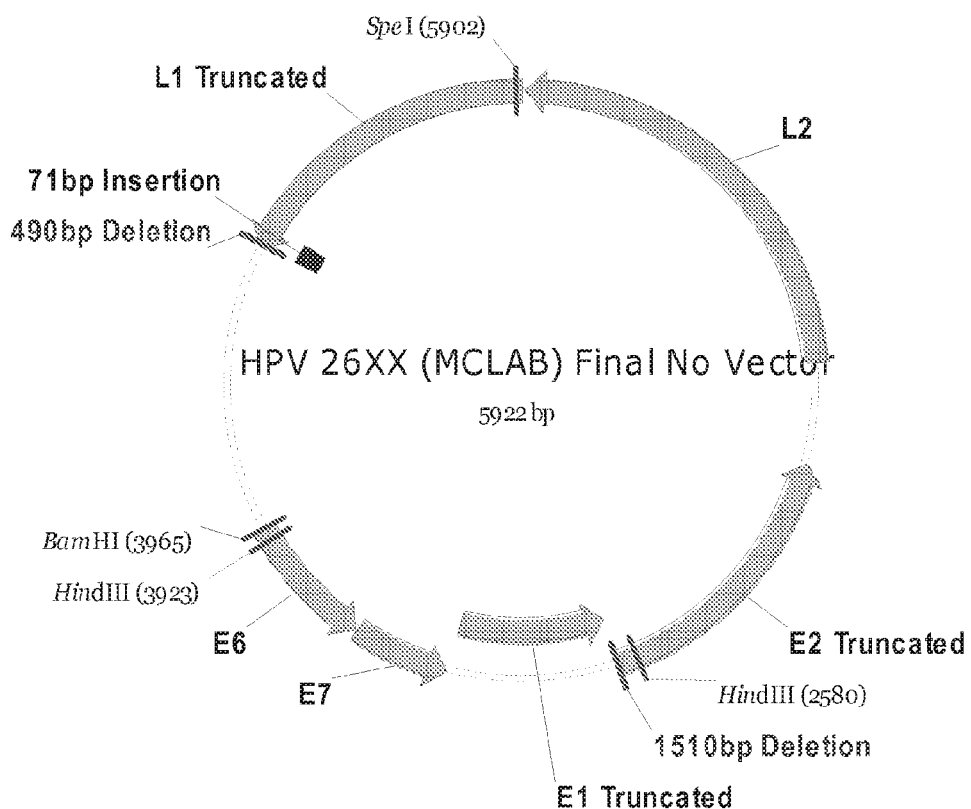

FIG 10B

HPV 26XX

Truncated Probe (SEQ ID NO: 117)

```
CTGAAAAAAAATAAGGCATACGTTTACGGCGTTTATGGATTAAATAAATATA
GGGCCATAAATAATAATTATCCCCATGCACAACTATTGCAGGTAAGTTAGTG
GTGGGTGGGGGGGGCAATGATGGCCATGTCGGGGAAGATGTGGGCGTGTAA
ATGTCTGACCCACTATATACAGGTAGTTCAAATGAGGTGGATAAAGGCACAG
TAACATTGGTAGTGGAAGTATTAATAGAGGAAAACACATTGGAGGCATATCT
TGGAACTGGTAATGTTGTAGGGGAATATGACATGCGCGGCGTATGTATGCTA
GGAACTGTATCAGGGTCTGCATATATATCAAACAAAGGTGCAGATGAATGGG
TAGATGTATGTAAAGGCTGCAATTCAATTTCTTCGTGTTCAGCAAAAGACTGT
ATAGGACTAATATCATGATAATAATGTACTGTAGCTCCAATTTGTTTTCCACT
ACGTGTTTTCATAGTGGCCTTTTGACCCAACCTACTATAGCGTACAGTACCTT
TGCGAGATGTAAGGGCCGGACGATGCAATGCAATAATGTCCAAAAAATCGG
GGTCAGGTGCTACAGTACTACTGGAAGCATATGTAAGTGTTTCATCTATAGGT
TCATATGCAGGATTATCAAAGGTAACAAATGTGGAGGGATTACCAATAAAAT
```

FIG. 10C

```
TGGGATCTGTAACCTTTACCTGTTGATAGGCCTTACTATACAAACGAGGAGCT
GACACTCGTTGTATACCAGGAATAGGTGTACTACTAATAGGTTCTAATCCTGT
TCCATTAGTAGAAGCAAATACTTCCATTGGAATTTCTTCATAACTATGTGTGC
CAGCTGTGGACGTTGTAGTAAATATATGACCTGATGCTTCCCCGGCCTGTGGT
ATATCTATAGGGGGTTCAATATATAATGGATTTTGTATATTGGTACTTGTTAC
ATGTACAGTACCAGCAGAGGGGGTGATGTCCAACACAGCAGGTGTTGTTGCA
GAGGATGTGGTAAGTTCAAAGCCATTGCCACCACTAAATGTAGGTATAGGGG
CTCCAGATTGTATAATACTAGATTCCTCCACCAAAGTAACTATAGAAGGTTCT
GTAGGACCCACAGGTTCAATAATAATGGGCGGACGGGTAGGGCCGATATCCA
CAACAGAGGGTCTACCACCCCCTCCTAGGGGAATGTATCCAGTACGCCCACC
AGACCCAGTTCCTGTACCTATACCAAGACCACCTAAAAATATTCCCAAACCA
CTCCATTGTAATATCTTATCAGCAAGGGTAGAACCTTCAATTTTAGGAATAAC
ATCAGGAGGGCACGTACCAGCGGCCTTACATGTTTTGTATAAGTCTGTAGCTG
ATGCTCGTTTGCGTCGAGGGGCACGGACAGCTACCATTGTAACACGTTTATTA
AAGGGACTAAGTAGCAATTACCATTACAGTATAAAAATGTAAAAAACAAGC
AGGTATAAAAAATAAGCAAATATACACAATATAGGTAGTTATATATGATGTA
GATACCACAAACCAAAAACAAAACACTAATAATAGCGAGGCTGCAAACACA
TAAATGGAAAGCAAAAGTGGCAACAAACAACACAGCAACACACACACACAC
ACGCAAAGCACAAACACATAAACTATAAAAGGAATAATGATTACAGGTATAT
AGGTGTGTTAGCAGCACATATTGGCTTGTGTGTTGGTAAAATATACACTATAT
TACAATGACATTATTCCCAATGTTGAAGTTATACTTTGTGGTATTTTAACAGT
TGTTAAAAAATTATTACGTTGTGTTATACTGTTAAAGGTAATTGTTACAATGC
CTTGTTGATTGGTATCATTACTGGTCCAATGCCAGGTAGATGATACATTGCAA
TACAATCCTTTATGCTTTTTAAATCTATATCTTAAACATTTTAAACTATTTGTA
TCACCTTTTAGGTGTACTATAAACACAGTTTGGTCACTACTCGTGTCCCTTCCC
GGGTGATGGCCTCCACTTGTACTGTGTAGGTTGTTGTTTGTATAGTCCACTGA
CTGTCCGGGCTGTGTGGCAGCTGTGGTGACAGTGGTGACTGTGGTGACGGTG
GTGTCAGGTCCACTGAGTCGTCGTCGCTTTCCTGGGTATGGCGCCTCGGTTTC
CTTGGTGCCCACGGGCACGTAGGCTTCGGTGGTCTGGGTGGTGGCGTTTGATA
CTGGCTCAGCAGTTTTAGCAGTGGATATTTGGTTGCTGCTGCAGGTACTAGAT
ACAAATTCAGGACAACAGATTACCTGACCACACACATGTACAGCCCATTGCA
CACCTGTCCCATATTTTTCCGCCTCTTGTTTAAAGTCCACGTAATACTGCTTAT
ATGCCCCTTGTGTATAATATATCCCTTTTGCATCAACATCTCCAGTACCTTTAC
ACCACCCTATATCAGTTTTATAATACACATATTTCCACCTAATATAATCCATT
GTATTTTCCTTATTACAATCAAATACCACTGTTACCGTTGTTCCTTCTTTTTTA
AAACAATGTTTAGGTTCTGTCATATACATTTCATAGCTTGTGTCTCGCATTGTC
CAAGCTTCTGTATTATAGTCCGTGTTTATTAACGACTGCAATGCTATATGTA
TTTCAATTGCCTGCCATGCCGTGTAACACTGTTTACATGTGTGTCTACAT
CGATATCTTCCACTGAGGCATTTGACCCCCCCTGACTACACACACTAGGCAAC
CCGCCATTTTCTTCATATTGTTTATCTACCTGTACGGGCGTAAGAGTTTCCACT
TCAGTATAGCCATACCCGCTGTCCGGTACACTGTCCACGGCTCTCCTTTTGGC
CTGTGAATTATTTACTTGGTGTGTATTCTGCTGACTGTCGCTTTGCTGTCTGTG
TTGATTTGTTATGTCTTGCAACGGGCTGTTCTGACTACCTAGTAACTTTCGTTT
TAAATTGCGCACTGCCTTTGTATTTGCCTGTTTTTGTTGTGCCTGAAACAATGC
CTGGGTTACCTCCTGTTCTGCATAATCACTTATACTACTATCATCTATAAATCC
TATTAGGTCCGACCCTGTATCACTACTATTGTCTGTTTCATCATCTGATATTGT
```

FIG. 10D

```
GTCCCCTGTATGTTTTTCCACTATAGCTTCTACTGAAAACCACCCTGTACACC
CCCGCCCCTCCTCATTTGTACCTTCACAGTCCATTGCAGGTTTTACTGTGCAGC
ACACTGATGGCACACCAAGGACACGTCTTCCATTAACATCTGCTCCAGCACT
CGAACGTTCTGTCGACTGCTCTGCACAGCTAGCTGCACTATACTATTACACAT
ACAACATTGTGCTTCAATTCTGTAACACACTTCTTGTCCAGCTTGTCTGGCCT
GCTGGTCACGCATATTATCTGTTTCATCCTCATCTGAGCTGTCAAATTGTTCAT
AGTCCAATTGTTCGTAGCAGCGTAGGTCAATTTCGGGTTGCGGCACCAGATCT
AGTATTACATCTTCAATATTAATTATGTTTCCATGCATTGTTCTTTACACTTGT
GTTTCTGTTTGGCGCCTTGGTCTCCAACAATTTGTACACAACCCTTTCCACTGC
CCTGCTATTTCGTGAAATCGTCGCTTTTCATCCACAATTCTTTGTTTTTCTTCT
GGCCCCAATGGCATTTGACATCTATGACACCTTATTAACAAATTACATAAACT
TTTTTTAGTTAAGGCTTCTAATGTTGCACCATACACAGAACATGTATAGCGTC
TATACTCTGTTATTTTTGAATAAAATATTACACATCTTTTGCATGCAGCATAC
GGACTCCTATCTCTATATACTACTCTTAGGTCACAAATTGCAAAATTATATAC
ATCAGCCCATTGTAAGGTTCCTTGCAATATACACACTGTACCTGCAAATTTT
GCAAAGTAGTATTCAAGCTTTCACATAGCTCATGTAGCGTTCTGGGTCGTTCT
CTAGGATCCTCGAACATAGCTGTTTTGCACGTAGCTAGCCTTTTACTTTTATAT
GTACCGGTTTCGGTTGCAACCGTTTTCGGTTACACCCTTTTAGTAACATATAA
TTGTTAAAAGTTATTATAAAGAAACTTGCATGCATTAACAAAACACATTTCGG
TTACATACACACCTGTGTTTAACTATGGGTTACAACAGTATGTGTCAGACACA
TAGTTGGCAAACAAAAGTGTATATGTTAGCCAACTATGCACTTAAAAGACCT
ATAAAATAAAATAAAAATATGTGCCTAACAGCAGTTTTATTATAATGTAAGA
AAAAGTGCTTATGTAAGTATTGTTTAAATATATGTGACTAATACAGGCGCGCC
ACTTATAGTGCCAAAATGGCAAGCCAAGCGTAGGAGGCAGGATGTGTTGTCT
GCCAAAGGATTAACTGTTCCTGCAGGATACAGCATGAAAGTTGGATAAAAAC
TAAAATAAGGAACGACCGAAAACGGTTGGGACAATAGATAGTAATAGAAAA
TATAAAAAGTAAAAATATAACACTACAAAAGTTTAGTGAAATACATATAAAA
GGTAAACTTGTGTAATATAATAATTATAAGGGACACCACCTAAGGTTCCTCCC
ATTACCTCAGGGGTAAAACAAATGACAAATAGTGTAGTAAAGACATGTAACC
ATGCATGAAGACACATTCATACTTTATTAAATAACAAGTATGCATACAAACA
GGAAAACACATAACCATGCATACATATAATACATACATACAAAACACGCCTT
TACATTACATACAGTTGTACACACATACAAACACACCTTACATAACATACCA
CAAACATATACACACACACAAACATGCGGAATTATTTAGTAAGTTTACGTTTT
TTGCGTTTGGTAGAGGAAGAGGTAGAAGATAAGGGACGTTTGGTGCCTAC
TTTCGGCCGTGTAACCAGTATGGCTTATTAAATAGTTGTGCATCCGAAGT
AACCATAGAGCCACTAGGTGTAGCAGAATAAATAGAAGATGTAGGGGGCTC
CCTGCCTGATTCAGCACCTTTAATATACAAAGTGGTGGGTATAGCATCCCCAA
CAGCCCCCGCCTTATTATAAAAATGTCTGGCAAATAATTGTTCCCGGCGAAG
AAAAAAAAAACATGCTGTTTCCATATGTATCTGCAGACATTTTAAGATAATCA
GGATATTTACATGTGGATTGACTAATATCAATGGGCACATCTGATTTGGTAGC
CTGTAAGGCAGTAAAATCCATAGCTCCAAAGCCTGTATCAATCATATCGCCA
TCCTCAATAATGCTGGAAATTAATTCTAAGGGGGGGCAATCCCCACGTTGTGT
CTGTGTATTTTTACATATAGTGCCAATACCCCAGTGCTCTCCCAAGGGCGGTG
TACAACCTATAATACATAACTGTGTTTGTTTATTATCAACTGAAACATTGTCC
CTGTTGTCAGTGTCTGCATTTACAGTAGCCAAATGAGAGTTTTCGGTATCATC
CAACTTATTAAACAAAGGATGTCCACTAAGGCCAATGCCTAATGGCTGTCCT
```

FIG. 10E

CTACCAACTTCAACACCAACACAGGCCCACACCAGGCGTTCTGTGTCAGGAT
TATATAACTGTGGATCAGGCAATCCAAATTTATTAGGATCAGGTAGGTGCAC
TCTAAATACCCTGTACTGATAGGCAGATACCTTAGGAATTTCGGCCTTTTGGC
CAGTTTTAGGTATGGAAAAATATGGATGTCCTAATGTTAATAAACGAGAGCT
GCCCGCATAATAATATATGCCGGTGCGAGTTACATATTCATCCGTGTTGACAA
CCCGAGACACAGGGGTGGGAGGAAGATATACCTTGCTGTCACTAGTACGCCA
CAAAGCCATC

FIG. 11A

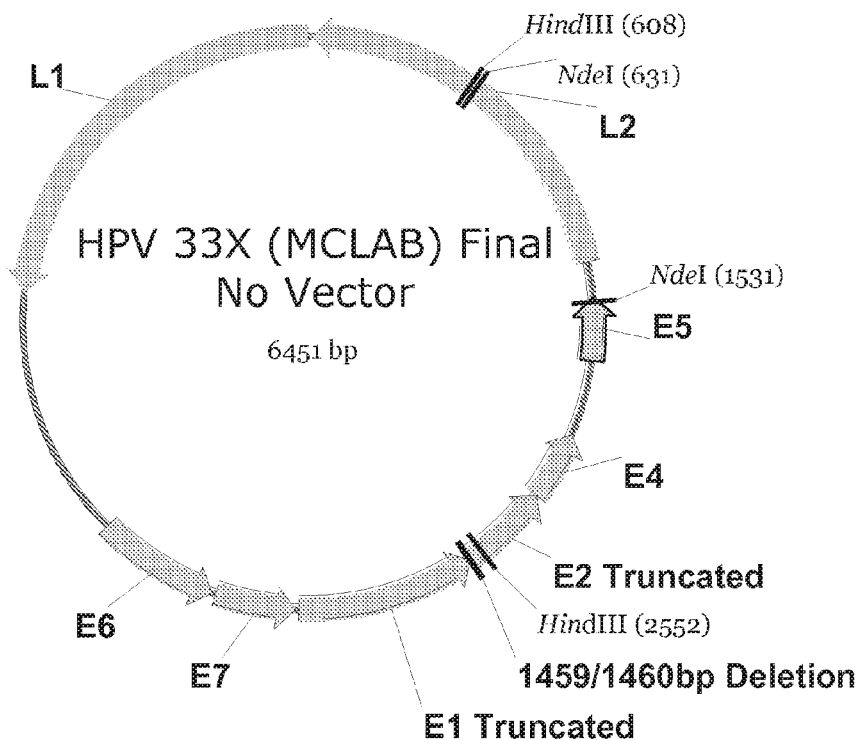

FIG. 11B
HPV 33X

Truncated Plasmid (SEQ ID NO: 88)
Truncated Probe Sequence (highlighted) (SEQ ID NO: 97)

```
TTCCCTATTATCAGCACCCGGTTGTCCAGGATACTTGTTACCGGTTTCAGTGT
CATCAAATTTGTTTAATAAAGGATGACCACTTATGCCAACGCCTAATGGCTGC
CCTCTACCTATTTCAAGGCCTACACATGCCCATACTAATCGTTGTGTATCAGG
GTTATAAAAGGAGGTGTCAGGAAATCCAAATTTATTAGGATCTGGTAAACGG
ACCCTAAAAACCCTATATTGCAAGCCTGATACTTTGGGTACCAATAATTTTTT
AGCGTTAGTAGGATTTTTAATAGAAAAATATGGATGGCCAACAGCAAGAAGT
CTGGAACTACCAGCATAATAATAAATGCTTGTGCGAGACACATATTCATCAG
TGCTGACAACTTTAGATACAGGTACAGGAGGCAGGTACACTGTGGCCTCACT
AGACCGCCACACGGACATCTCGAGGGGGGGCCCGGTACCCAGCTTTTGTTCC
CTTTAGTGAGGGTTATTGCGCGCTTGGCGTAATCATGGTCATAGCTGTTTCCT
GTGTGAAATTGTTATCCGCTCACAATTCCACACAACATACGAGCCGGGAGCA
TAAAGTGTAAAGCCTGGGGTGCCTAATGAGTGAGCTAACTCACATTAATTGC
GTTGCGCTCACTGCCCGCTTTCCAGTCGGGAAACCTGTCGTGCCAGCTGCATT
```

FIG. 11C

AATGAATCGGCCAACGCGCGGGGAGAGGCGGTTTGCGTATTGGGCGCTCTTC
CGCTTCCTCGCTCACTGACTCGCTGCGCTCGGTCGTTCGGCTGCGGCGAGCGG
TATCAGCTCACTCAAAGGCGGTAATACGGTTATCCACAGAATCAGGGGATAA
CGCAGGAAAGAACATGTGAGCAAAAGGCCGGCAAAAGGCCAGGAACCGTAA
AAAGGCCGCGTTGCTGGCGTTTTTCCATAGGCTCCGCCCCCTGACGAGCATC
ACAAAAATCGACGCTCAAGTCAGAGGTGGCGAAACCCGACAGGACTATAAA
GATACCAGGCGTTTCCCCCTGGAAGCTCCCTCGTGCGCTCTCCTGTTCCGACC
CTGCCGCTTACCGGATACCTGTCCGCCTTTCTCCCTTCGGGAAGCGTGGCGCT
TTCTCATAGCTCACGCTGTAGGTATCTCAGTTCGGTGTAGGTCGTTCGCTCCA
AGCTGGGCTGTGTGCACGACCCCCCGTTCAGCCCGACCGCTGCGCCTTATCC
GGTAACTATCGTCTTGAGTCCAACCCGGTAAGACACGACTTATCGCCACTGG
CAGCAGCCACTGGTAACAGGATTAGCAGAGCGAGGTATGTAGGCGGTGCTAC
AGAGTTCTTGAAGTGGTGGCCTAACTACGGCTACACTAGAAGAACAGTATTT
GGTATCTGCGCTCTGCTGAAGCCAGTTACCTTCGGAAAAAGAGTTGGTAGCT
CTTGATCCGGCAAACAAACCACCGCTGGTAGCGGTGGTTTTTTGTTTGCAAG
CAGCAGATTACGCGCAGAAAAAAGGATCTCAAGAAGATCCTTTGATCTTTT
CTACGGGGTCTGACGCTCAGTGGAACGAAAACTCACGTTAAGGGATTTTGGT
CATGAGATTATCAAAAGGATCTTCACCTAGATCCTTTTAAATTAAAAATGA
AGTTTTAAATCAATCTAAAGTATATATGAGTAAACTTGGTCTGACAGTTACCA
ATGCTTAATCAGTGAGGCACCTATCTCAGCGATCTGTCTATTTCGTTCATCCA
TAGTTGCCTGACTCCCCGTCGTGTAGATAACTACGATACGGGAGGGCTTACC
ATCTGGCCCCAGTGCTGCAATGATACCGCGAGACCCACGCTCACCGGCTCCA
GATTTATCAGCAATAAACCAGCCAGCCGGAAGGGCCGAGCGCAGAAGTGGT
CCTGCAACTTTATCCGCCTCCATCCAGTCTATTAATTGTTGCCGGGAAGCTAG
AGTAAGTAGTTCGCCAGTTAATAGTTTGCGCAACGTTGTTGCCATTGCTACAG
GCATCGTGGTGTCACGCTCGTCGTTTGGTATGGCTTCATTCAGCTCCGGTTCC
CAACGATCAAGGCGAGTTACATGATCCCCCATGTTGTGCAAAAAAGCGGTTA
GCTCCTTCGGTCCTCCGATCGTTGTCAGAAGTAAGTTGGCCGCAGTGTTATCA
CTCATGGTTATGGCAGCACTGCATAATTCTCTTACTGTCATGCCATCCGTAAG
ATGCTTTTCTGTGACTGGTGAGTACTCAACCAAGTCATTCTGAGAATAGTGTA
TGCGGCGACCGAGTTGCTCTTGCCCGGCGTCAATACGGGATAATACCGCGCC
ACATAGCAGAACTTTAAAAGTGCTCATCATTGGAAAACGTTCTTCGGGGCGA
AAACTCTCAAGGATCTTACCGCTGTTGAGATCCAGTTCGATGTAACCCACTCG
TGCACCCAACTGATCTTCAGCATCTTTTACTTTCACCAGCGTTTCTGGGTGAG
CAAAAACAGGAAGGCAAAATGCCGCAAAAAAGGGAATAAGGGCGACACGG
AAATGTTGAATACTCATACTCTTCCTTTTTCAATATTATTGAAGCATTTATCAG
GGTTATTGTCTCATGAGCGGATACATATTTGAATGTATTTAGAAAAATAAACA
AATAGGGGTTCCGCGCACATTTCCCCGAAAAGTGCCACCTAAATTGTAAGCG
TTAATATTTTGTTAAAATTCGCGTTAAATTTTGTTAAATCAGCTCATTTTTA
ACCAATAGGCCGAAATCGGCAAAATCCCTTATAAATCAAAAGAATAGACCGA
GATAGGGTTGAGTGTTGTTCCAGTTTGGAACAAGAGTCCACTATTAAAGAAC
GTGGACTCCAACGTCAAAGGGCGAAAAACCGTCTATCAGGGCGATGGCCCAC
TACGTGAACCATCACCCTAATCAAGTTTTTTGGGGTCGAGGTGCCGTAAAGC
ACTAAATCGGAACCCTAAAGGGAGCCCCCGATTTAGAGCTTGACGGGGAAAG
CCGGCGAACGTGGCGAGAAAGGAAGGGAAGAAAGCGAAAGGAGCGGGCGC
TAGGGCGCTGGCAAGTGTAGCGGTCACGCTGCGCGTAACCACCACACCCGCC

FIG. 11D

GCGCTTAATGCGCCGCTACAGGGCGCGTCCCATTCGCCATTCAGGCTGCGCA
ACTGTTGGGAAGGGCGATCGGTGCGGGCCTCTTCGCTATTACGCCAGCTGGC
GAAAGGGGGATGTGCTGCAAGGCGATTAAGTTGGGTAACGCCAGGGTTTTCC
CAGTCACGACGTTGTAAAACGACGGCCAGTGAGCGCGCGTAATACGA*CTCA*
*CTATAGGGCGAATTGG*AGCTCCACCGCGGTGGCGGCCGCCTGTAAAAAAA
TATGGAAAACGTTTACGCCTGCGACGTAAAATAAAATAACTAGGATGTAAAA
CAAAGTCAGCACCGTCTACAACAATGGTGTCAAAAGGAAAAAAAGGCGAAA
TAGGAACAAATGGGCTAGATGTGGGAAATAAAGGGGAAGGTATATCAGGGC
CAGACATAACAGGAGTATCAAATCCTGTATTTAAAGGTATAGACACATTGCT
GGTACGTGTTGTTGCAAACGTACTGTATGAGTGTTGCATTGGGGTGTGTACAT
TATCCACATCGTCAGCATAAACATCATACAAACCATCATTAATACTATAAGA
CGATGTAGAAGTATCATGTAAAGGCTGTAATTCATATTGTTCATTTGGCACGG
TGTGGTCTAAAGGCACAATAGGACTTAAATCCTGATAATAATGTATTCTAGCT
CCAATTTGTTTACCACTGCGAGTTTTAAGTGTGGCTTTTTGACCTACTCTACTA
AAACGCACAGTATGTCTACGAGATGTAATAGCAGGCCTATGTAATGCAATAA
TATCTAGAAAGTCAGGATCAGGAGCAGGTGATATATCACTATGTTGAAATTG
TAATGTGTCTTCAGGGTCAAAGCTTTCAAATGCAGGATTATCATATGTTATAA
GTTTATGAGGCGATGTTAAAAAAGCAGGGTCAACAACCTTAACCTGTTGGGT
ATTGCGACTATATAAACCAAGGCGTGCCACAGGGCGAGACCCTGGAATGGGC
GTGCTTGATGTTACATTACTACTGTCTGTGGAAACAACAAAGGTATCCATTGG
TATGTTTTCATAACTTTGTGTGCTAACAGTAGGGGAAGAAAATATAAAATGTC
CAGAGGCTTCTGCAGGCGCTGGAGGGTGTAGTACAGATGGTTCAGTAAATGT
GGGATTTAAATGTGTAGAAATAGTTTGAATAGATGACTCCCCAACAGATGAA
ACATTAATAATTGCAGGTGTAGTATCTGCAGATGTAGTAACATCAAAACCTG
ATGGTGTAGGAATAGATGGGGCTGGTGCACCTGCCTCTATAAAACTTGTTTCT
TCTATTAATGACACTATAGACGAGTCTAAAGGTCCAACAGTGTCTACAGTAA
CCGGAGGACGTATAGGCTGCAAGGGGATTGCAGCTGTAGGTGGGTCAGTACC
AATAGGTACATAGCCAGTCCTTCCACCTGAACCAGAGCCTGTGCCAATACCT
AAACCACCAAAAAAAACCCCTAAACTGCCATATTTAAGAATTTGATCTGCTA
TGGTACTTCCTTCCACTTTAGGAATAACATCGGGTGGGCAGGTGCCTGTGGCC
TTGCATGTTTGGTATAGTTGTGTTGCAGATGCACGCTTGCGCCTTGTAGATCG
TTTGTGTCTCATAATAATACACTGCTAAAATATAAAGGTATTTATTAGTAATA
CAAAAAAAAAAAAAACTAAAATAACAACAACAATGTTAAAACACCACCATGT
GCACATATATACAAACAATATATACATGTATATACATTACTCTTGTTGTGTCA
TATGCTGTGCATGAAAATTAATACACATCATTGGTAAATATAAAAACAACAA
ATAGCAAAAAAAAATTTTTAAAGGAGATCCCACAAACACCCAAAGCAGCAA
TACCAACACCTGCAACCAAGCATAGGTAGAAATGGAAAGTATTAAAGGACGT
AATAATAAGGATAAGCATAAAAACAATATAAAACATAATACAAAAACAAAT
ATCATGGTTATATACAATTAGCAGCACATATTGGCTTGTGATGTACACTTATA
ATGTCATAAATCCAGTACTTATTTGCACAGTAGGTGGTATTTTTACGGTACCT
AAAAACATTTGTTGTTGCTGTTCAGTTACAAATGTTACAGTTACAATTCCATT
TTTACTATTTTTGTTGTCACTGGTCCAATGCCAGGTGGATGACATAGAACTAT
ACAACTCTTTATAAGGTTTTAATCTGTATCTTAAACATTTTAAACTATTTGATT
CACCTTTTAAATGCACTATAGGTGCAACGTTAGGACTACACACAGTCCGCTGC
TTGTTTGTGCAGTTAGTTGCAGTACGTGCTGTTCTATTGTCCAAGGCGGGGTC
TGCACAGAACAGCTTTGTAAGGGGCTGGGCGGTGTCTGTGGTGTCTGCAGGT

FIG. 11E

```
CGTCGTCGTTTGGCCGCTGCTTGTGGTGGTCGGTTATCGTTGTCTGTCTGTATG
TCAGCAGTTTCAGTAGTGGATATTTGGTTGCTAGATATAGACGTAGGACAAA
CAATTACCTGACCACCCACATGTACTTCCCACATTTGTGTTTTAGAATACTTT
GCAGCATCCTCTTTAAAATATTTAAAATATACCTTTTCACAGTTATGTATATA
ATACATACCTATATAATCTACTTTCCCTGTAACCATAGTACATGTATCTTCCTC
TATAATATATATTTCACCCCAGTTTGTATAATCCATTGTATTTTTTTTGTCATT
GTCATATTGCACAGTTACTGTTTCTCCTTGTTTTTTAAAACATTTTGGTGGTTC
ACAAAGCCACACCTCTAAGCTTGTTTGTTGCAATGTCCATTGGCTTGTACTA
TACTGTGATTACTTAATGTCTTACTAATTCCATAAAACTTATTCCATAGG
CCTCTTTAAATTTATATAATATATTTGCTTTTGTATTACTACTATGTAGAACAT
TACTAATTTCCTGCAACGTAACATTTTCACAGCTATCTACATTTGTCTCACAG
CTTACTTCTGAATCATCCCCCACCCCACTAGATTCTAAGTCATTTAAGTTTGTG
TCGCCATTTTGACTTTCTACCTGTTGTACCATCTGCTGAGTTTCCACTTCAGTA
TTGCCATATCCGCTGTCTTCTAGCTCATCTATTTTCGTTTTCTGTATGTGCATT
CTTTATTTTTATTAATAGACGTTCTACACGGGTTTGCAGCACGATCAACAACG
TCCTCCGCAGCACTTTGTGAACATGCGGCAAACTTTCGTTTTAGTGCACACAC
AGCATTTAAATCATCCTCCCCTTCCTGTATATTAAACAATGCCCGGGCTGCCT
CTGTGTCTGCCTGTATACTATTTTCCATAGAATCATCTATAAACTCTAGTAAA
TCCGTGCCACTGTCATCTGCTGTTTCATCCTCATCTTCTGAAATATTATCTCCT
GTTCTTCTCTCTATGACTGCTTCTACCTCAAACCAACCAGTACACCCCATCCC
AGCCCCATTTGTACCTTCAGGATCGGCCATTGTAGATGATGTTTATTGTTGTG
CACAGGTAGGGCACACAATATTCACTGTGCCCATAAGTAGTTGCTGTATGGTT
CGTAGGTCACTTGCTGTACTGTTGACACATAAACGAACTGTGGTGTTACAAGT
GTGACAACAGGTTACAATGTAGTAATCAGCTGTGGCTGGTTGTGCTTGTCCAT
CTGGCCGGTCCAAGCCTTCATCCTCATCTGAGCTGTCACTTAATTGCTCATAG
CAGTATAGGTCAGTTGGTTCAGGATATAAATCTAAAACATATTCCTTTAACGT
TGGCTTGTGTCCTCTCATGGCGTTTTTACACGTCACAGTGCAGTTTCTCTACGT
CGGGACCTCCAACACGCCGCACAGCGCCCTGCCCAACGACCCGAAATATTAT
GAAATCGTTTGTTTAAATCCACATGTCGTTTTTTTCTTGAGGACACAAAGGT
CTTTGACATATAATACACCTAATTAATATTTCATTTAAAGGTTTTTTAACTGTT
TGTTCTAATGTATTTCCATATACAGAATAATTATAATGTCTATATTCACTAATT
TTAGATAAGAACCGCAAACACAGTTTACATATTCCAAATGGATTTCCCTCTCT
ATATACAACTGTTAAATCTGCAAATGCAAAATCATATACCTCAGATCGTTGCA
AAGGTTTTTTGCATTCCACGCACTGTAGTTCAATGTTGTGTATAGTTGTCTCCA
ATGCTTGGCACAAATCATGCAATGTTCGTGGTTTTTCCTCAGTGTCTTGAAAC
ATAGTCGTGCAGTACCTTACTGCAAAATGGTTGCTTTATATATGCACCGTTTT
CGGTTGAACCGCTTTCGGTTACACCCTACTTTTTTAAAACTTGGCATTATAGTT
TACTATTATATAAAAGATTATAAATGACCAATATGACCTAAAACGGTTAGTC
CACACCTGGTAATAAACAGGTAGTGACTCACTTTTACAAGGCATAGTTTGGC
ATACAAAGCAATTGTGTAAGCCAAAACTGCACTTAAGGTTTGAAAGTAAAGT
AAAAATATGTGCCTAAAAGCATGTGTAAACTATTAGTACAATTAAGTATTTTG
CAATTGCACTGCATGTATATATGAGTCAATGCAGCAAGTACAGACAAACACA
GTGCAGGAAAGAAAAGGATTAACTGTTCTGCCAATGTCATAGGGTATGTATG
CCAATGCAGCAAGTACAGACAAACACAGTGCAGGAAAGAAAAGGATTAACT
GTTCTGCCAATGTCATAGGGTATGTATGCCAAGTAACCGAAAACGGTTAGGC
ATACAAAATGGAGGAAATTGTACAATATGGACACTAGTATGTCAAAAGGTAA
```

FIG. 11F

```
AGCAATACTAAACATGTAGGTACTACAAATATAGGGAAATAAAGGTAGGTAC
ATTGCAATGCAGGGTAGGGCAAGCAATACAACTCCTTACTCATATAGGTACA
CCCATATACATAACATACATACAAATAGTTTAACAAATACACACAATGTTTTA
TTAACATATACACAAACAGGAAACTGACAAGTACATAGAACATGCACACAA
ACAAGTACACATAAAACAAACACAGTAACATACAACATAACATACATTGTAA
CACATACACAAAAAACAAACAACAACACAACACAACAACACAAAGTACATA
GACAGAACAAAACAACAACATAACACAATTACACAAAGTGTTATTTTTTAAC
CTTTTTGCGTTTTGCAGACGATGTGCGGGTGGATGTGGGGGCTGCACGTTTAA
GTTTAGGTTTTGCTTTAAGACCTGCCTGTAATAAAAACTTGCGTCCCAAAGGA
AACTGATCTAAATCTGCTGAAAATTTTTCCTTTAAATCCACTTCCCAAAAATGT
ATATTTACCTAAGGGGTCTTCCTTTTCCTTTGGAGGTACTGTTTTTTGACACGT
AATAGCCTGAGAGGTAACAAACCTATAGGTATCCTGTAAACTAGCAGATGGA
GGAGGTGTTAAACCAAATTGCCAATCTTCTAAAATATCTGGATTCATAGCATG
AATATATGTCATAACTTCTGCAGTTAAGGTAACTTTGCATAGTTGAAAAACAA
ACTGTAGATCATATTCTTCAACATGTCTTATATATTCTTTAAAATTTTCATTTT
TATATGTACTGTCACTAGTTACTTGTGTGCATAAAGTCATATTAGTACTGCGA
GTGGTATCTACCACAGTAACAAATACCTGATTGCCCCAACAAATACCATTATT
ATGACCTTGTGCACGTTGTAGCCAATATGGCTTATTAAATAACTGAGATTCGG
AAGTAACCATTGATCCACTAGGAGTGGGAAAAAAAGCACTGCTTTGAATAGA
GGCAGTAGTTCCTGAACCTTTAATGTACAGGTCATCGGGAACAGCCTCTCCTA
ATGTACCAGCCCTATTAAAAAGTGTCTTACAAACATTTGTTCACGTCGAAGA
AAGAAAAATAAACTATCACCATAAGGCTCACTAGTCATTTTTAAATAATCTG
GATATTTGCATGTACTGCCACAAATATCAATAGGAACATCACTTTTATTAGCC
TGCGATGTTTTAAAAATCCATGCAACCAAATCCTGTGTCCACCATATCACCATC
CTCAATAATAGTATTTATAAGTTCTAAAGGTGGACAATCATTGGCAGGTGCTG
CATTAGTACAAGCAACACCTTTACCCCAATGTTCCCCTGTTGGAGGCTTACAT
CCAAGTAAACATAACTGTGTTTGTTTATAATCCATGGATAAACA
```

FIG. 12A

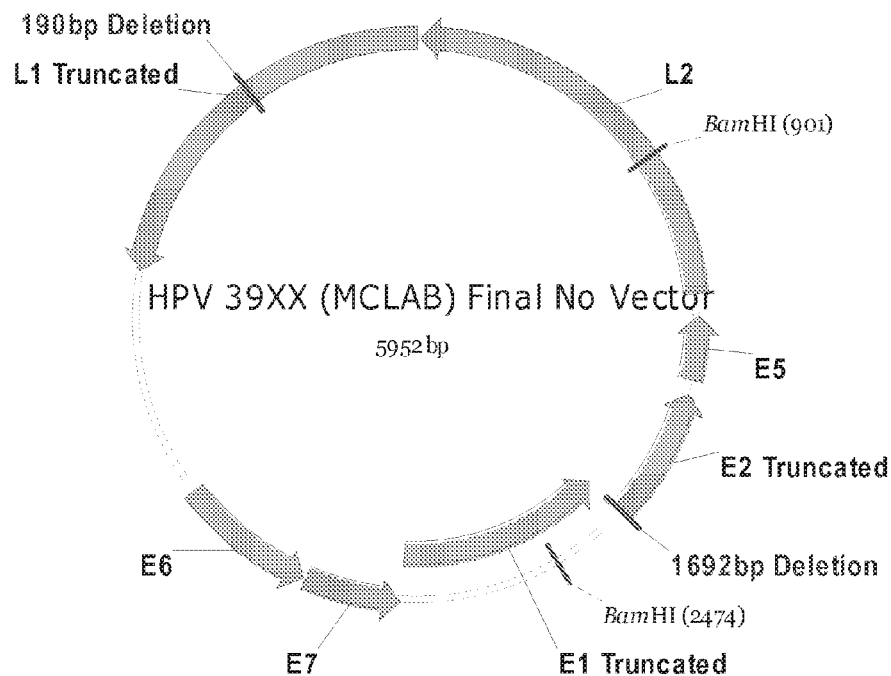

FIG. 12B
HPV 39XX

Truncated Plasmid (SEQ ID NO: 89)
Truncated Probe Sequence (highlighted) (SEQ ID NO: 98)

CATCTCGAGGGGGGGCCCGGTACCCAGCTTTTGTTCCCTTTAGTGAGGGTTAA
TTGCGCGCTTGGCGTAATCATGGTCATAGCTGTTTCCTGTGTGAAATTGTTAT
CCGCTCACAATTCCACACAACATACGAGCCGGGAGCATAAAGTGTAAAGCCT
GGGGTGCCTAATGAGTGAGCTAACTCACATTAATTGCGTTGCGCTCACTGCCC
GCTTTCCAGTCGGGAAACCTGTCGTGCCAGCTGCATTAATGAATCGGCCAAC
GCGCGGGGAGAGGCGGTTTGCGTATTGGGCGCTCTTCCGCTTCCTCGCTCACT
GACTCGCTGCGCTCGGTCGTTCGGCTGCGGCGAGCGGTATCAGCTCACTCAA
AGGCGGTAATACGGTTATCCACAGAATCAGGGGATAACGCAGGAAAGAACA
TGTGAGCAAAAGGCCAGCAAAAGGCCAGGAACCGTAAAAAGGCCGCGTTGC
TGGCGTTTTTCCATAGGCTCCGCCCCCTGACGAGCATCACAAAAATCGACG
CTCAAGTCAGAGGTGGCGAAACCCGACAGGACTATAAAGATACCAGGCGTTT
CCCCCTGGaAGCTCCCTCGTGCGCTCTCCTGTTCCGACCCTGCCGCTTACCGG
ATACCTGTCCGCCTTTCTCCCTTCGGGAAGCGTGGCGCTTTCTCATAGCTCAC
GCTGTAGGTATCTCAGTTCGGTGTAGGTCGTTCGCTCCAAGCTGGGCTGTGTG
CACGAACCCCCCGTTCAGCCCGACCGCTGCGCCTTATCCGGTAACTATCGTCT

FIG. 12C

TGAGTCCAACCCGGTAAGACACGACTTATCGCCACTGGCAGCAGTCACTGGT
AACAGGATTAGCAGAGCGAGGTATGTAGGCGGTGCTACAGAGTTCTTGAAGT
GGTGGTCTAACTACGGCTACACTAGAAGAACAGTATTTGGTATCTGCGCTCTG
CTGAAGCCAGTTACCTTCGGAAAAAGAGTTGGTAGCTCTTGATCCGGCAAAC
AAACCACCGCTGGTAGCGGTGGTTTTTTTGTTTGCAAGCAGCAGATTACGCGC
AGAAAAAAAGGATCTCAAGAAGATCCTTTGATCTTTTCTACGGGGTCTGACG
CTCAGTGGAACGAAAACTCACGTTAAGGGATTTTGGTCATGAGATTGTCAAA
AAGGATCTTCACCTAGATCCTTTTAAATTAAAAATGAAGTTTTAAATCAATCT
AAAGTATATGAGTAAACTTGGTCTGACAGTTACCAATGCTTAATCAGTGA
GGCACCTATCTCAGCGATCTGTCTATTTCGTTCATCCATAGTTGCCTGACTCCC
CGTCGTGTAGATAACTACGATACGGGAGGGCTTACCATCTGGCCCCAGTGCT
GCAATGATACCGCGAGACCCACGCTCACCGGCTCCAGATTTATCAGCAATAA
ACCAGCCAGCCGGAAGGGCCGAGCGCAGAAGTGGTCCTGCAACTTTATCCGC
CTCCATCCAGTCTATTAATTGTtGCCGGGAAGCTAGAGTAAGTAGTTCGCCAG
TTAATAGTTTGCGCAACGTTGTTGCCATTGCTACAGGCATCGTGGTGTCACGC
TCGTCGTTTGGTATGGCTTCATTCAGCTCCGGTTCCCAACGATCAAGGCGAGT
TACATGATCCCCATGTTGTGCAAAAAAGCGGTTAGCTCCTTCGGTCCTCCGA
TCGTTGTCAGAAGTAAGTTGGCCGCAGTGTTATCACTCATGGTTATGGCAGCA
CTGCATAATTCTCTTACTGTCATGCCATCCGTAAGATGCTTTTCTGTGACTGGT
GAGTACTCAACCAAGTCATTCTGAGAATAGTGTATGCGGCGACCGAGTTGCT
CTTGCCCGGCGTCAATACGGGATAATACCGCGCCACATAGCAGAACTTTAAA
AGTGCTCATCATTGGAAAACGTTCTTCGGGGCGAAAACTCTCAAGGATCTTA
CCGCTGTTGAGATCCAGTTCGATGTAACCCACTCGTGCACCCAACTGATCTTC
AGCATCTTTTACTTTCACCAGCGTTTCTGGGTGAGCAAAAACAGGAAGGCAA
AATGCCGCAAAAAAGGGAATAAGGGCGACACGGAAATGTTGAATACTCATA
CTCTTCCTTTTTCAATATTATTGAAGCATTTATCAGGGTTATTGTCTCATGAGC
GGATACATATTTGAATGTATTTAGAAAAATAAACAAATAGGGGTTCCGCGCA
CATTTCCCCGAAAAGTGCCACCTAAATTGTAAGCGTTAATATTTTGTTAAAAT
TCGCGTTAAATTTTGTTAAATCAGCTCATTTTtAACCAATAGGCCGAAATCGG
CAAAATCCCTTATAAATCAAAAGAATAGACCGAGATAGGGTTGAGTGTTGTT
CCAGTTTGGAACAAGAGTCCACTATTAAAGAACGTGGACTCCAACGTCAAAG
GGCGaAAAACCGTCTATCAGGGCGATGGCCCACTACGTGAACCATCACCCTA
ATCAAGTTTTTTGGGGTCGAGGTGCCGTAAAGCACTAAATCGGAACCCTAAA
GGGAGCCCCCGATTTAGAGCTTGACGGGGAAAGCCGGCGAACGTGGCGAGA
AAGGAAGGGAAGAAAGCGAAAGGAGCGGGCGCTAGGGCGCTGGCAAGTGTA
GCGGTCACGCTGCGCGTAACCACCACACCCGCCGCGCTTAATGCGCCGCTAC
AGGGCGCGTCCCATTCGCCATTCAGGCTGCGCAACTGTTGGGAAGGGCGATC
GGTGCGGGCCTCTTCGCTATTACGCCAGCTGGCGAAAGGGGGATGTGCTGCA
AGGCGATTAAGTTGGGTAACGCCAGGGTTTTCCCAGTCACGACGTTGTAAAA
CGACGGCCAGTGAGCGCGCGTAATACGA*CTCACTATAGGGCGAATT*GGAGC
TCCACCGCGGTGGCGGCCGCCTGAAAAAAAATAGGGAATACGTTTCCGTTTT
TTTAGGAAAAAATACAATAATGGCAACAAATAATAATTGGAACCCTGAATGG
TTATTGCATATGTTGTGTCTATTGGTCCAGAAGGCACCAATGGCAACTGTGGA
GTAGTACTTGGTAAAGCAATATCAGGACCAGTATTTACAGGCATATTCCATG
AGGTACTAAAAGGAATAGTTGTATTGGCATATTTAGTAGATGCTGAAGAAGC
CACAGAAGGTAGTGAGCCTGTGTTATATGTAGTGCCCGAATCCCTTGTATTAT

FIG. 12D

```
TAAATGCAGTATCTAAATATGTGTTATTGTCCACATCAGCATATATATCAAAT
AATGCATCTGAAGCATCAGAGGGCTCAGCGTGAACTAGGGGCTGTAATTCAA
TGCTTTCAGCAGGAGCAATACTACTAATGTCATGGTAATAATGTACTTGCGCT
CCAATTTGTGTGCCACGCCGGGTAACCATGGTAGCCTTTTTGCCAAGCCTACT
AAACCTTACTGTTCCTTTACGCGAGGTTAAGGCAGGCCTATGTAAACGAACA
ATGTCCAGAAAATCCGGATCTGGAGCTATGTCAGCAGCTTCATATGTTAATGT
AGTATCAACAGGCTCAAAAGCAGGATTATCAAATGTTACAAATGATGAAGGG
TGAGTTACAAAATCAAAATTACTAACACGAACCTGCTGATGTGCTCTACTATA
TAAACGTGGTCCTGCCACACGACTGATTCCAGGTGTAGGTGTGCTGCTAATA
GGTTCGGTACCTGTGCCATGTGTGGCAAACACTTCCATAGGTATTTCCTCATA
GCCATGTGTACCTGATGTAGGGGTACTGACAAATATATTACCCGAGGTTTCAC
CTGTTTGGGGAACCTCAATTAAGGAAGGATCCGTAAAGGCAGGGTTAGTATA
ACTAGTAGAGGTTATTTGTACAGACCCAGAGGAGGGTGTAATATTCAATACC
GCAGGCGTAGTAGTAGAAGAAGAAGTAATTTCAAATCCAGAGGTGCCTGTAA
ATGTTGGTACTGGTGTTCCAGAGGTTATAACACTTGAGTCCTCCACCAATTGC
ACAATAGATGGCTCAGAAGGACCAACAGGTTCAATAGCTACAGGTGGACGTG
CAGGAGACACATCTACAACAGTATTAGGCCTACCCCCCAGGGGTATATATCC
TGTGCGTCCCCCAGTACCAGTACCTGTGCCTATGCCTAACCCACCCAAAAATA
TACCTAAACCAGTCCACTGTAAAATTTTGTCAGCAAGTGTAGTACCCTCAACT
TTATCAACAACGTCTGGTGGACAGGTACCCGATTGTTTACAGGTTCTATATAG
GTCAGTTGCAGATGCACGCTTACGCCTGGCAGCACGGTGGGAAACCATGTTT
ATTAGTAACAAAAAAAAATATAAAAAGCTATGTACAGTAGTTATGCACAATG
CACATACATATACAGTACTATATCATATCCATTGCCAGTCTATGCAACAACCA
CATGGGCAATACAAAAAATAGTAAATATACAAAAAACACCTCCAATGGTGTG
GTACGTATAAGAATAAACACAAACACAATTATCCACACATACGCACACACAT
GCACAGACGGCAAAAGCGGGACATTGCAACATATATATATACACACACCAA
ACCACACCAAAAATACCAATAATATCATCTATGTAGTATGTATACAATATAC
ATACACAATACCCATAGTATACTTTACAATGTCATGTAACCCAATGAAACAT
GTACACTAGAAGGTATTTTAACAGTGTCCAGAAATTTTTGGCGTTGTGACTCT
GTGGCATATGTAACAGTTAATATGCCAGCGTTTTTGGTTCCCTTACCCCGTAT
CCAATGCCAGGTACATGAAATATTTTCAAACAATGTGTCATATTTTTGTAGTC
TATATCTTAAACATTTTAAACCATTTTTGTCACCTTTTAAATGTATTATAGGCG
TAGTGTTACCACAACTGAGGTACCGTCTTGTGTTGTGGCCTGTACTGTTACTG
TGGAGTGGGTTGTTAAGATGGTCCAGGGACACTCCGTCGGGCTCAGTGGCT
CTGTGACTGCACACTGTCGAGGTCGCTTTCGAGACGGCGGCGGGATTGTTTTT
TGGGTGCATGGGGTTGTTGCGGTGGAATGGGTCGCGGTGGTGTTTGATAAT
TCGGTAGTAAGTTATTAGCATTAAAATTAGTACTCCTTGTTTTGTGTCTAA
GCTTTGTATATGTGTATATAAGGCATATTTGTTGATTAATGTTTTAAATCCTTC
TGCAATAGTTGGATGTACTCCAAATATGGCTGCCACCCAGTCTGTACATGTTG
TTTTATCACTTTTAAACGTACGTACCAGGTCAGTAAGGATAGTCCATATGTTT
CTTTAAATTGTGTTAGCATTGCAGCCTTTTTGTTATTGGATTGTAACAATAATT
TAATTTGTGCAGTTGGAGATTTGGGATCCTGGTTTTCACTATCTATAGCACTA
TCCACACTACTACACTCCTCCCGTACACTGCCGCCATGTTCCCCTTCAGCATC
CCCATTTGTATTAGTTGCTACAGTTACCTCCTCCACTTCAGCTGTTTCCACTTC
CATATTGCCATATCCGCTGTCTGGCACGGAATACACCGTTTGTGTTGCCTGCG
TACTGCTTACATTTAATGAAATTTCCTGTAGTGTTCCCCTGGTATTCCTGCCTA
```

FIG. 12E

```
CTTTTTTTCCATACGGTCTAGTGTCGCCACTGCTGTCTGTATACTTTCGTTTTA
AGGCACGCACTGCTTGTGCATCCCTTTGGGCCTCTTGCATATGTAAAAGTACC
TGTGCTGTCTCACGCTCTGCCTGTACACAAATATCTGTGGAATCATCAATAAA
GTCTGCCAGGTCTGAACCTGTATCTGTTGCATTTTCATCCTCATCCTCCGACAC
TGTGTCGCCTGTTTGTTTATCTACTATTGCCTGTACTAGAAACCATCCGTTACA
TCCCGACCCATCCCCGTCTGTACCTTCACGATTGGCCATAGCAGGTTACTGGT
TTGCAGTTGCACACCATGGACACACAAATCCTAGTGAGTCCATAAACAGCTG
CTGTAGTTGTCGCAGAGTATCCCGTGAGGCTTCTACTACCAGCTGCAGTGTGT
TGTTACACTTACAACACGAACACTGCATTGTGTGACGCTGTGGTTCATCCCGT
CTGGCTAGTAGTTGATGTTGGTGATTAACTGCATGGTCGGGTTCATCTATTTC
ATCCTCTGACTCTCCTAATTGCTCGTGACATACAAGGTCAACCGGCTGTATTT
CATTGTAAGGACATAAATCTAATACAATTTCCTGCAAGGTGGGCTTTGGTCCA
CGCATATCTGATGTTATACTTGGGTTTCTCTTCGTGTTAGTCTGCGGTCCTCCC
GTTTTGTGGTCCAGCACCGTCGACACTGTCCTGTATAGCTTCCTGCTATTTAT
GAAATCTTCGTTTGCTATTTAGGTGTCTTAATTTTTCTGCTGGACACAGCGGTT
TCAGACAACACATGCACCTTATTAATAAATTATATAACTTTGTATTAGTTATA
TTTTCTAATGTAGTTGCATACACCGAGTCCGAGTAATATCGTAGCTCCCGTAT
TTTAGCATAAAATTTTATACATGATTGGCATGCAGCTAGTGGTTCCCCGTCCC
TATATACTACATATAAATCACTAAATGCAAATTCATATACCTCGGTTTGCTGT
AGTGGTCGTCTGCAATAGACACAGGCTATTGTAATGTCCTGCAAGGTGGTGT
CCAGCGTTGTGCACAGGTCTGGCAATTTGTATGGCCGTTCTGCAGGATTGTGA
AATCGCGCCATCGGTATGGACAGAAACTGTGACTGCGTTTTATATCCACCGAT
TTCGGTCCTGACCGTTTTCGGTTACTCCCTTTTTTAAACAAGATACTTATAAA
ATGTTATAAGTAAAAGTATAGGTATGTATGCCCAACCTATTTCGGTTGCATAA
ACTATTGTGTGCTACATTAGTCACTTGTATAACTTATACTGTAAGACACATTC
CTGAATCAAAAAGTAGTTATACAGGCCAACTATTTAATTAAGCAAGTAAAAA
CAGCTAAAATATATGCCTAAAAGCAGTTTTATTACATAGGGTGGAGATATGG
ATGTTGCCAAAGTATTGTTGCAGTGCACCTGGACAGGATGATGAGTAATAAG
GCGCGCCAGTAAAACTGTTACCAGTGCCAACTATGCAGGGTGAACCTAAGGT
AAAGACATGTTTTTGCTGAGAAAGGTGGTTTCCACTAGTTTAAAAAAAATGC
TCAACCCACGACCGACTTCGGTCGCCACAAAATGGCGAAGTATAAAATGTAG
AAACGCGTACAACAATGTAAAAATTACATATTAGGTAGTAAACACACCTTAG
GGTAGGGCATATAGATTATGTATGAAATGTTGCAGACCTATTATATGTAAAA
CAAATACACTGTTAGTCACAGGGTGTGCAATCACACATGAAACTGTCATACA
TACTTTATTAACAAAAACATATACACACATACCTACAAACATACACATATAC
ACTCAACACATAAGGAAACAAACAACATACACACACATAACAAGGCATACA
CATGCATTATTTAGACACACGTTTACGTTTGTGTTTAGTAGCTGAGGACGAGG
AAGTGGATGCAGCAGGCCGCTTTCGGGGACCTATGGTAGGGCGCCTGCGGAC
CCTGGCCTGCAACAAAAATTTACGTCCCAAAGGGAATTGATCAAGTTCCAAA
CTAAACTTTTTCCCTTAAGTCAACATTCCAAAACTTTAGACCGTCATATGGATC
TTTCTTTTCAGGTGCTGGAGCATCCTTTTGACATGTAATGGCTGCAGACTGTA
GGTATCTGTAAGTGTCTACCAAACTGGCAGATGGTGGAGGAGCTACAGCAAA
ATTCCAATTGTCCAATATAGAGGAATTCATAGTGTGAATATAAGACATAACA
TCAGTTGTTAATGTGACAGTACACAGTTGAAATATAAATTGTAAATCATACTC
CTCCACGTGCCTGGTATATTCCTTAAACTTAGAAGGATCATATGTAGAAGGTA
TGGAAGACTCTATAGAGGTAGATAATGTAAAGTTGGTACTACGGGTAGTGTC
```

FIG. 12F

CACAACAGTAAGAAATAATTGATTATGCCAACATATACCATTGTTGTGGCCCT
GGGCCTTATGTAGCCAATAAGGCTTATTAAATAACTGGGAATCAGAGGTTAC
CATGGAACCGCTGGGAGAGGGGCAGTATACAGAACTACCGGGGTTTGCACGT
ATATCTGTGCCCTTAATA<u>TACAATTGGGCAGGAATGGCGTCACCCACCTAT</u>
<u>CAATCATATCACCATCCTCAATAGGGG</u>TGTTTACTAGTTCCAAAGGAGGAC
AGTCCCCCGTAGATACATTATTGGGCTTGCATGCCTTTCCCTTACCCCAGTGC
TCCCCAATGGCGGGAACACAGCCTATAATGCACAACTGTGTCTGTTTATAATC
CACAGACACATTATCCCTACTGTCCTTATTGGTGGTTGATGAAAATGGTGAGT
TTTCAGTATCATCCTGTCTATTATATAATGGGTGTCCACTAATACCAACACCC
AATGGCTGGCCCCTGCCCACCTCCACCCCTACACAAGCCCATACTAAACGTT
GTGTTTCTGGATTATATAAGGATGCATCTGGAATACTGAATTTATTAGGATCG
GGCAATGTCACGCGAAATACCCTATATTGATATGCAGACACCTTTGGAATGT
CCTGCTTGCGACCACCATTCATACCCACTTTAAAATATGGATGTCCTACTGTT
AATAATCTAGAGCTGCCAGCATAATAATATATGCCTGTGCGTGTAACATAAT
CATCAGTATTGACAACCTTCGCCACAGAAGGTGGAGGCAAATACACCATGCT
GTCACTAGACCGCCACATAGC

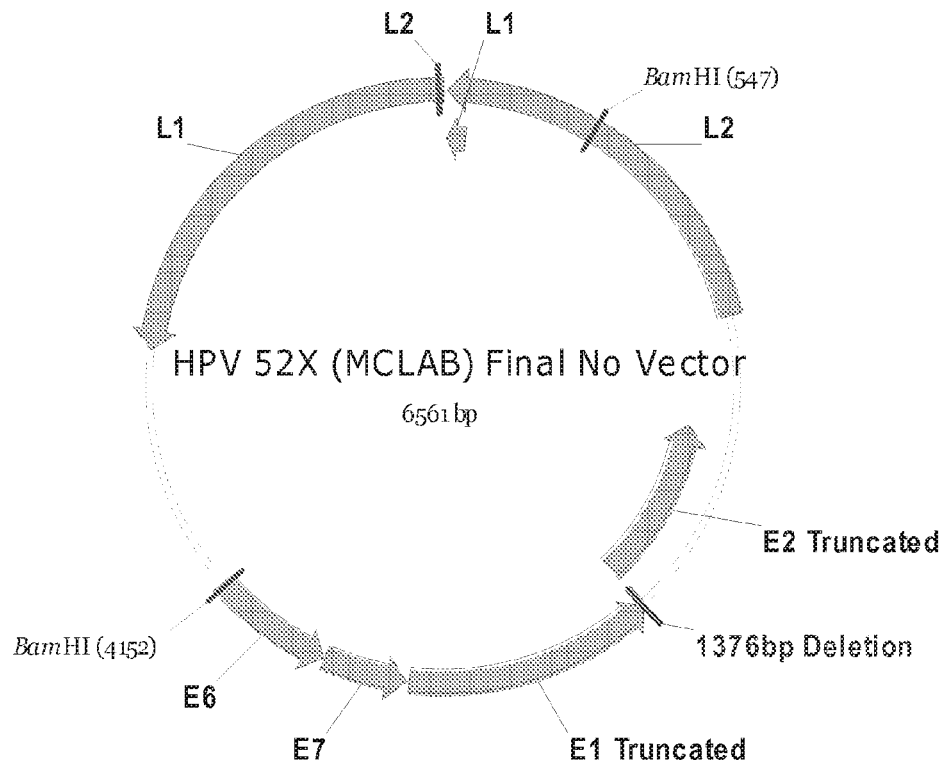

FIGURE 13A

HPV 52X (MCLAB) Final No Vector
6561 bp

FIG. 13B

HPV 52X

Truncated Plasmid (SEQ ID NO: 90)
Truncated Probe Sequence (highlighted) (SEQ ID NO: 99)

```
GCCTGTAAAAAAATATGGAAAACGTTTACGCCTGCGACGTAGTAAAAAATAA
CTAGGATGTAAAATAAAATCTGTACCATCAACAATAATAGATGTAGATGGAG
CTGTAGGGGCTATAGGAACAAAAGGAGTATGTGTGGGTAACGAAGGTAATG
GAATGTCAGGACCTGACTCAATGGACATAGTGGGTTGATATACAAAGTCAAT
ACCACTATTAATAGGTACAGTGAAAGTATTATTATGGGTAGAAAGTGTGGAA
GGTAAGTGAAACGTGGGTTGCTGCAAAGAATCTGCATACACATCATACAAAC
CATCATTAATAGTGTAAGGGGACACAGACTGTGGTAATAAAGGTTGCAATTC
TATGTCTTCCTGAACTTCAGCAGGCTGGATAGGACTAATATCATGATAATAAT
GTACCCGTGCCCCAATTTGTTTTCCACTACGTGTACGTAGGGTGGCCTTATTA
CCAAGCCTGCTAAACCTAACAGTACCTCTTCGAGAGGTTAATGCAGGCCTAT
GCAAAGCTATAATGTCTAAAAAATCAGGATCCGGTGCAGGTAAAAGTTGTGA
ACGATCAAAAATTATAGTTTCATCTGTATCAACGCCCTCAAAAACAGGATTGT
TATATGTTACTAATTTCTGTGGTGATGACATAAAAGCAGGGTCGACTACCTTA
```

FIG. 13C

```
ACCTGTTGTGTGGCACGGCTATATAAACCAAGGCGTGTCGTAGGGCGAGACC
CTGGAATAGGTGTACTACTTGTTACACTGCTGCTGTCAGTAGAGGTAACAAAT
GTATCCATAGGGATTTTCTTCATAGGTGTGTGTACTAATAGTTGGACTAGAAAA
CAATACATGACCAGATGCTTCTGCAGGTGCCGGGGGCTGTATTATAGATGGT
TCAGTGAATGTAGGATTTAAATGTGTAGAAACTGATTGTACAGATGATTCAC
CTATAGATGTTACATTAATTATTGCAGGAGTATTATTGCAGATGTTGTAACA
TCAAACCCTGTTGCTGATGGAATAGATGGAGCAGGTGCGCCAGACTCAATAA
ATGTTGTTTCTTCTATCATAGAAACTATAGATGGTTCTAAGGGACCAATGGGT
TCTACAGTTACAGGGGGACGAATGGTGGACGTGGTAATACTACTAGTGGGAG
GACGAGTGGACAATGGCACATAGCCTGCCCTACCACCAGAGCCTGCACCTGT
ACCTATACCCAAACCTCCAAAAAACACCCCTAGGCTGCCATATTTTAAAAGT
TGATCTGCAATAGTTGTGCCTTCCACTTTAGGAATAACATCGGGGGGGCAGG
TGCCAGAGGCTTTGCATGTTTGATATAGCTGTGTTGCAGAAGCACGTTTGTGC
CGTGTAGACCGTCTGTATCTCATTGCGACAAGCTATTAAAAAATATAAAAGT
ATTTATTAGACAAACTACAAAAGTGAAAAAGTATATTTTGCATATATGCATGT
AGCCAATCTACATGTACAGTTATTGCAGTTGTGCCAAATACTGTGCATGACAG
TGAATACAAAACATTGGAAAATATAAAAACAGTAGGTACAAAAAAAACACT
TTAAATGGTGACCCAATAGATACCCATAGCAAAAGCACCAGCACCAACACCT
GCGCATACACCGATATAGATAGCAAGAGCGGCCTAAGCACTGCACAAAACA
CCATAAGCAAAATAAAACAAAATACAAATAATCCTAACATTGTTATATATAC
ACAATAGCAGCAATATTGGCTTGTGTTGGGTGTTTACCATACACATATACATA
TATACATATGTACAAATATCACAATGACATGACACCTTGTATAACTTGCACAG
TATTTGGTATTTTAACAGTTTTTAAAAATTGTTGACGTTGTGTTTCATCACTGT
ACGTTATTGTTACAATACCTAGTTTATTATTTGTACATTCATTACTGGTCCAAT
GCCAGGTAGATGAAATTTGAACATACAAACTTTTATGTGTTTTTACCCTATAT
CTTAAACATTTTAAACTATTAGGATCACCTTTTAGGTGTATTATAGGTGCAGT
ACAAGTTGTATGTGCAACCCGTCCTTTGTTTGTGCACTCAGTTGCAGTGACGA
GTCCCCGTGTAGTACTGTCCACGGATTGTTGTCCCCGCAAAAGGTTGTTGGGG
TACTTGGTGTTTCTGGAGTCTGTGACGTCTGGTCGTCGTCGTTTCTGTGGTGGT
TGTAGGTGTGTGTCTTTGGCACCCACGGACACTGCGGAGGTCTTGGAGGTTTC
GGTGCATAGGTGGACAGCAGTTTCAGTAGTGGATACTTCGTTACTAGATACA
GATGCAGGACAAACAATTACCTGACCACCCACATGTACTTCCCATACTCCTGT
TACACAATATTGCTTTGCATCGTTACTAAATTTTACAAAATATATTTTTCTCC
ATCACACCAATAATATAACCCATAGTAATCTACTTGTCCTTCTACAATTGTAC
ATTCACACTCACCAAGTAAATAAATTTCCTTCCATATGTGTTTCTGGTATA
TTTAACAGCTGTGACATTAGTTTGGACACTGTTAATCTGTTTTTTCCACATTT
AAACCTAATTAGCAGCAGTATAAGCACGCCTCTGTCACATGTTAAACATTGC
AAATGGGCATATATGCTATAGGGCTGTATTAATACTTTTAATCCTTCTGCAAC
TGATGGTGTTACTCCCATTCCTATAATACACCAATCTGTACAACTACTTCTATT
ACTTTTAAATGGTCTTACTAATTCCATAAAGCTAACACCATATGTTTCTTTAA
ATTTAAATAATACAGTTGTTTTTATGCTATTTTCGCACATAATATTTTGTATGC
TTTTTAGCGTTCTATTACTATTTTCCTCATTGTCCTCTATACTAGTACAACTTA
CATCTGAATTACTAGCCCCCACCCCACTTGATTGACTACTGTTACTTTGCCAG
TCGCCATTTTGCCCGTCTACCTGGTCTGCCATCTGCTGCGCTTCCACTTCACTA
TTGCCATAGCCGCTGTCTTCTACGTGACATGGTTTGCGTTTTGGTAAAACACA
CTCTGTATTTACACAAATGTGTTTTGCACGCGGACTACCATGTTTTTCTACACC
```

FIG. 13D

```
ATCTTGCCCAGCACTTTCCGGACTGCTTGTAAACTTTCGTTTTACTGCAGACA
CAGCATGTAAATCATCCTCCCCTTCCTGTGCATTAAACAATGCCCGGGCTGCC
TCATGTTCTGCCTGTTCATTATTTATATTTGAATCATCTATAAAATCTATTAGA
TCTGTTCCACTATCATATGCATTTTCATCCTCGTCCTCTGAAATGTTATCTCCT
GTTTGTTTTTCTATTATTGCCTCTACTTCAAACCAGCCTGTACATCCCTCCCTT
TCGCCCTCTGTACCTTCAGGGTCCTCCATTGCAGGGTTGTTTATAGCCGTGCA
CAGCCGGGGCACACAACTTGTAATGTGCCCAACAGCATTTGCTGTAGAGTAC
GAAGGTCCGTCGCAGTGCTATGAATGCATAGCCGTAGTGTGCTATCACAACT
GTGACAATATGTCACAATGTAGTAATTGCTTGTGGCTTGTTCTGCTTGTCCAT
CTGGCCGGTCCACACCATCTGTATCCTCCTCATCTGAGCTGTCACCTAATTGC
TCATAGCAGTGTAGGTCAGTTGTTTCAGGTTGCAGATCTAATATATAATCTTT
TATAGTTGCTTTGTCTCCACGCATGACGTTACACTTGGGTCACAGGTCGGGGT
CTCCAACACTCTGAACAGCGCCCTGTCCAACGACCCATAATATTATGAAATC
GCTTGTTTGCATTAACATGTCTTTCTTTTTCTTCAGGACATAATGGCGTTTGAC
AAATTATACATCTAATAGTTATTTCACTTAATGGTTTTTTTACCCTCTCTTCTA
ATGTTTTCCCATACAGTGAATATTGATAATGCCTATATTCACTTATCTTAGAT
AAAAAGCGTAGGCACATAATACACACGCCATATGGATTATTGTCTCTATATA
CTATTCGTAAATCTGTAAATAGAAACTTGTATACCTCTCTTCGTTGTAGCTCTT
TTTTGCACTGCACACACTGCAGCCTTATTTCATGCACCGATTCTTCCAGCACC
TCACACAATTCGTGCAGGGTCCGGGGTCGTGTTGCTGGATCCTCAAACATGG
CCGTGCGTTAGCTACACTGTGTTCTATATATATACACCGGTTTCGGTCTGACC
GTTTTCGGTTACACCCTATTTTTTACTAGTATAAGATTATAATTTATAATTATA
AAAAAAAGTGGTTGTGGGTACGGTAACCGTAACCGGTCGTGTAGTGCACACC
TGGTGAGTAACAGTATTTAATCATGTTTTACAAGACATATTTGGCGTAGGATG
TACTTGTGTAAGCCAACACTGTAATTAGTGCATTGAAAGTTTAAATAAAAATAT
GTGCCTAAAAGCAGTTTAAAACATGCAATGTTAGGCAATGTATTGTTTAGCTG
CACTGCAGGACCTGTGAGTCAGCAAGAAGTCAGTTTAGGCGGGACAACAAGT
GTAGACCAGTGGACTGCAGGAAACCAAAGGATTAAGCAGTTTGCTGAAACTT
ATATAAAAATAGTTGTTACTGTGCCAAGGACAACCAAAGTTGTGCCAAGACC
AACCGAATTCGGTTAGGATTTAAAATGGTGGATAGTACAAAATGGTACAAAA
TGGAGAGTATAAGGCTAATTAGTAGTGTAACAAAGTAGGACACAGGGTAGG
GCAGGGGACACAGGGTAGGGCAGGAGATGCAATAGATTAGGAGCAACTGTA
TTGTTACTCATGTGGGTGCAACCATAACATAAGACTACTATAAATAGTTTAGT
AAATACAGTACTTTATTAATACATACACAAAACATACATACAGGAACTGACA
AATACAACAAACATGCACACACATACATAACATGCAAACAACACAGTACAC
ACACAAAACAATTACATAACAAACAATGGTTACCTTTTAACCTGTGTTTGACA
TACACAACACATACATGACACAGACAATTACCCAACAGACAATGGTTACCTT
TTAACCTTTTTCTTCTTTGTGGAGGTACGTGGGGCCGATGATGCAGGGCGTTT
TAGTTTGGGCCTAGCCTGTAGCCCTGCCTGTAACAAAAACTTCCTACCTAAAG
GAAACTGATCTAAATCTGCAGAAAACTTTTCTTTTAAATCCACCTCCCAAAAC
ATATAGTCCTTTAAAGGATCTTCCTTTCCTTTAGGTGGTGTGTTTTTTTGACAA
GTTATAGCAGTAGAAGTGACAAATCTGTATGTGTCCTCCAAAGATGCAGACG
GTGGTGGGGTAAGGCCAAATTGCCAGTCCTCTAAAATAGTGGCATCCATCTT
ATGAATGTATGTCATAACATCAGCTGTTAATGTAATTTTGCACAATTGAAAAA
TAAATTGTAAATCAAATTCCTCGCCATGACGAAGGTATTCCTTAAAATTTTCA
TTTTTATATGTGCTTTCCTTTTTAACCTCAGCACATAAAGTCATGTTAGTGCTA
```

FIG. 13E

```
CGAGTGGTATCCACAACTGTGACAAACAACTGATTGCCCCAACATATGCCAT
TATTGTGGCCCTGCGCACGTTGTAACCAGTACGGTTTATTAAATAATTGGGAT
TCTGAGGTTACCATAGAACCACTAGGAGTAGGAAAAAAAGCACTGCTTTGTA
CAGTGGCAGTATTGCCAGAGTTAGACCCTTGTATATATAAATCACCTGGCAC
AGGGTCACCTAAGGTACCGGCCCTATTAAAAAAGTGTCTAACAAACATTTGC
TCACGTCTAAGAAAAAAGAACAAACTGTCACCATATGGCTCGCTAGCCATTT
GCAAATAATCTGGATACTTACATACACTGCTACATATATCAATGGGCACATC
ACTTTTACTAGCTTGCAAGGTATTAAAATCCATGCAACCAAATCCTGTATCTA
CCATGTCCCCATCCTGTATTACACTGTTAATGAGCTGTAGGGGAGGACAATCC
CCAGGATTTCCTGAATTATTATTACAAGGGGTTCCCTTACCCCAATGTTCACC
TATAGGAGGTTTGCATCCTAAAATGCATAACTGAGTCTGCTTATAATCCATAG
ATAAACATTCCCTATTATCTATACCAGGTTTACCAGCATATTTGTTACTGGTTT
CAGTATCATCAAACTTGTTTAATAAAGGATGCCCACTAATACCCACACCTAA
AGGCTGTCCCCTACCAATTTCCAAGCCTGTACAGGCCCACACCAACCTTTGGG
TTTCTGGGTTATAAAAAGATGTATCTGGAAAACCAAATTTATTAGGGTCCGGC
AATTTAATTCTAAATACCCTGTATTGCAGGCCAGACACCTTGGGAACTAAAA
CTTTTTTACCATTACCACTACTGGTGTTTTAATAGAAAAATAGGGATGTCCT
ACTGTTAGTAATCGAGAACTGCCTGCATAATAATAGATGCTTGTGCGAGACA
CATACTCATCAGTGCTTACAACCTTAGAGACAGGTACAGGAGGCAGGTACAC
AGTGGCCTCACTAGGCCGCCACACGGACATCTCGAGGGGGGGCCCGGTACCC
AGCTTTTGTTCCCTTTAGTGAGGGTTAATTGCGCGCTTGGCGTAATCATGGTC
ATAGCTGTTTCCTGTGTGAAATTGTTATCCGCTCACAATTCCACACAACATAC
GAGCCGGGAGCATAAAGTGTAAAGCCTGGGGTGCCTAATGAGTGAGCTAACT
CACATTAATTGCGTTGCGCTCACTGCCCGCTTTCCAGTCGGGAAACCTGTCGT
GCCAGCTGCATTAATGAATCGGCCAACGCGCGGGGAGAGGCGGTTTGCGTAT
TGGGCGCTCTTCCGCTTCCTCGCTCACTGACTCGCTGCGCTCGGTCGTTCGGC
TGCGGCGAGCGGTATCAGCTCACTCAAAGGCGGTAATACGGTTATCCACAGA
ATCAGGGGATAACGCAGGAAAGAACATGTGAGCAAAAGGCCAGCAAAAGGC
CAGGAACCGTAAAAAGGCCGCGTTGCTGGCGTTTTTCCATAGGCTCCGCCCC
CCTGACGAGCATCACAAAAATCGACGCTCAAGTCAGAGGTGGCGAAACCCG
ACAGGACTATAAAGATACCAGGCGTTTCCCCCTGGAAGCTCCCTCGTGCGCT
CTCCTGTTCCGACCCTGCCGCTTACCGGATACCTGTCCGCCTTTCTCCCTTCGG
GAAGCGTGGCGCTTTCTCATAGCTCACGCTGTAGGTATCTCAGTTCGGTGTAG
GTCGTTCGCTCCAAGCTGGGCTGTGTGCACGAACCCCCCGTTCAGCCCGACC
GCTGCGCCTTATCCGGTAACTATCGTCTTGAGTCCAACCCGGTAAGACACGA
CTTATCGCCACTGGCAGCAGCCACTGGTAACAGGATTAGCAGAGCGAGGTAT
GTAGGCGGTGCTACAGAGTTCTTGAAGTGGTGGCCTAACTACGGCTACACTA
GAAGAACAGTATTTGGTATCTGCGCTCTGCTGAAGCCAGTTACCTTCGGAAA
AAGAGTTGGTAGCTCTTGATCCGGCAAACAAACCACCGCTGGTAGCGGTGGG
TTTTTTTGTTTGCAAGCAGCAGATTACGCGCAGAAAAAAGGATCTCAAGAA
GATCCTTTGATCTTTTCTACGGGGTCTGACGCTCAGTGGAACGAAAACTCACG
TTAAGGGATTTTGGTCATGAGATTATCAAAAAGGATCTTCACCTAGATCCTTT
TAAATTAAAAATGAAGTTTTAAATCAATCTAAAGTATATATGAGTAAACTTG
GTCTGACAGTTACCAATGCTTAATCAGTGAGGCACCTATCTCAGCGATCTGTC
TATTTCGTTCATCCATAGTTGCCTGACTCCCCGTCGTGTAGATAACTACGATA
CGGGAGGGCTTACCATCTGGCCCCAGTGCTGCAATGATACCGCGAGACCCAC
```

FIG. 13F

GCTCACCGGCTCCAGATTTATCAGCAATAAACCAGCCAGCCGGAAGGGCCGA
GCGCAGAAGTGGTCCTGCAACTTTATCCGCCTCCATCCAGTCTATTAATTGTT
GCCGGGAAGCTAGAGTAAGTAGTTCGCCAGTTAATAGTTTGCGCAACGTTGT
TGCCATTGCTACAGGCATCGTGGTGTCACGCTCGTCGTTTGGTATGGCTTCAT
TCAGCTCCGGTTCCCAACGATCAAGGCGAGTTACATGATCCCCATGTTGTGC
AAAAAAGCGGTTAGCTCCTTCGGTCCTCCGATCGTTGTCAGAAGTAAGTTGG
CCGCAGTGTTATCACTCATGGTTATGGCAGCACTGCATAATTCTCTTACTGTC
ATGCCATCCGTAAGATGCTTTTCTGTGACTGGTGAGTACTCAACCAAGTCATT
CTGAGAATAGTGTATGCGGCGACCGAGTTGCTCTTGCCCGGCGTCAATACGG
GATAATACCGCGCCACATAGCAGAACTTTAAAAGTGCTCATCATTGGAAAAC
GTTCTTCGGGGCGAAAACTCTCAAGGATCTTACCGCTGTTGAGATCCAGTTCG
ATGTAACCCACTCGTGCACCCAACTGATCTTCAGCATCTTTTACTTTCACCAG
CGTTTCTGGGTGAGCAAAAACAGGAAGGCAAAATGCCGCAAAAAAGGGAAT
AAGGGCGACACGGAAATGTTGAATACTCATACTCTTCCTTTTTCAATATTATT
GAAGCATTTATCAGGGTTATTGTCTCATGAGCGGATACATATTTGAATGTATT
TAGAAAAATAAACAAATAGGGGTTCCGCGCACATTTCCCCGAAAAGTGCCAC
CTAAATTGTAAGCGTTAATATTTTGTTAAAATTCGCGTTAAATTTTGTTAAAT
CAGCTCATTTTTTAACCAATAGGCCGAAATCGGCAAAATCCCTTATAAATCAA
AAGAATAGACCGAGATAGGGTTGAGTGTTGTTCCAGTTTGGAACAAGAGTCC
ACTATTAAAGAACGTGGACTCCAACGTCAAAGGGCGAAAAACCGTCTATCAG
GGCGATGGCCCACTACGTGAACCATCACCCTAATCAAGTTTTTTGGGGTCGA
GGTGCCGTAAAGCACTAAATCGGAACCCTAAAGGGAGCCCCCGATTTAGAGC
TTGACGGGGAAAGCCGGCGAACGTGGCGAGAAAGGAAGGGAAGAAAGCGA
AAGGAGCGGGCGCTAGGGCGCTGGCAAGTGTAGCGGTCACGCTGCGCGTAA
CCACCACACCCGCCGCGCTTAATGCGCCGCTACAGGGCGCGTCCCATTCGCC
ATTCAGGCTGCGCAACTGTTGGGAAGGGCGATCGGTGCGGGCCTCTTCGCTA
TTACGCCAGCTGGCGAAAGGGGGATGTGCTGCAAGGCGATTAAGTTGGGTAA
CGCCAGGGTTTTCCCAGTCACGACGTTGTAAAACGACGGCCAGTGAGCGCGC
GTAATACGA*CTCACTATAGGGCGAATTGG*AGCTCCACCGCGGTGGCGGCC

FIGURE 14A

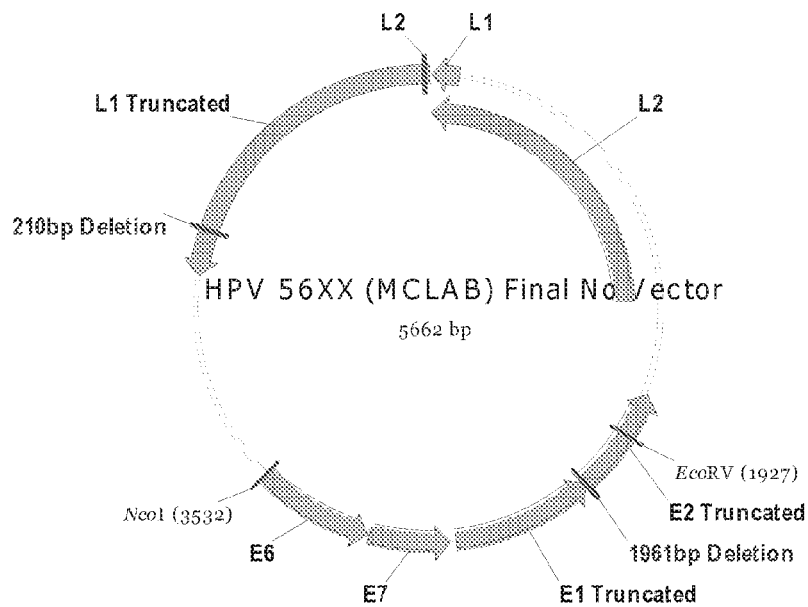

FIG. 14B
HPV 56XX

Truncated Plasmid (SEQ ID NO: 91)
Truncated Probe Sequence (highlighted) (SEQ ID NO: 100)

```
GGATCCCTGTATATATACATCATGGGTAACATCATAAGGAGACTGAGGAACA
AAGGGCCACGTACTGGGGCCTGTAGGCAACACTATGTCAGGACCTGAATAAA
ATGGTGTTTCCCACACATTACCTAAAGGGGCAGTTACATTAGTGGTGTTACTA
GCAAAAGACAATGTGGAAGGCTTTATAGGTAAGTGTGCAGAAGGTGTAGCA
ACTGACTGGCTAGACAAACCAGGTGCTTCATCATCTATATTTGCATAAATATC
ATATAGGCCATCAAATGAATTATTTGCAGACAATAATGGCTGCATTTCAATTT
CCTCAGCCTGTGCAATAGGACTTATATCATAATAATAATGCACACGGGCACC
TATTTGTGTGCCTCTACGTGTTTGTATAGTAGCCTTTCTGCCAAGCCTACTAAA
ACGTACACCACCCCTACGTGTAGTAAATGCAGGCCTATGTAATGCTACTATAT
TCATAAAATCAGGGTCAGGAGCCACACCCGACGGAGAAAAAGCTAAAGATG
TGTCAGTACCTTCAAAAAGTGGATTATCAGCAGATACTAATGTTGCAGGTCTA
TCAAGAAATGCAGGGTCAGTTACCTTAACCTGCTGAAATGCTTTTCTATATAA
TCTAGGAGCTGCAATACGCCTAAAGCCTGGAATAGGAGTACTACTAATAGGT
TCTGTACCAGAACCGTGAACAGCAAATGTTTGCATAGGTATTTCTTCATAGCT
ATGTATACCAGATGTGGGTGTGCTAATTAAAATATTGCCAGACACCTCGCCTG
TTTGTGGGGCCTCAATAACAGGGGGATCAATAAATAACGGATTGGTTATATG
GGTACTACTGACATGTACAGTACTAGAGGTTGGTGTAATATCCAACACGGCA
```

FIG. 14C

```
GGTGTAGTTGTTGATGAGGATGTAATTTCAAATCCCCCAGACCCAGTAAAATT
AGGAATCCCTGCACCAGATTCTATAACACTGGACTCCTCAACTAATGTAACA
ATGGAAGGGTCTGTAGGCCCTACGGATTCCACAACAATAGGTGGTCGCGCCG
GAGTTACATCAACTATTGTGGAAGGCCTAGACCCCAATGGAACATAGCCTGC
ACGACCCCCAGACCCAGTTCCTGTACCAATGCCAAGGCCTCCAAAATATGTA
AATAAACTTCCCCATTGCAATATTTTATCAGCCCATGTTTTTTGCTCTATTTTA
TTAACAACATCCTCTGGACATGTACCAGACAACTTACATGTTTTATATAGTTG
TGTTGCAGATGCGCGTTTGCGTCGTGTGGCACGGTGGGCAACCATAGTAGTA
ACAGTACTACTACATTTACATATTATTTATTATCCACAAAGCATGTAAATATA
TACACAGCACAGGACAGTAAAAAAATATCAAAAATATTATAAATGTATTAAA
AAAGGATGTGGCTATAACAAACCAAAACAATATTATTAATAATATACAACTG
GAAAACACAGAGGCAGATAGCAAAAGCGGGACAACATGACACACAAGCAA
ACAAACACAAAAGCAAAGCGCAAACACACCAATAACACAAAAATCAATGGT
TGCAATATATATGCGTAGCAGCAATGTATGGCAGGTACACTTCACGTATTTGT
GTGTTACAATAACACAAATGTATATACAATATATACAGCACTTTATGGAAAA
CTCATTTGTCCCAAACTAACCTGTACACTACTGGGAATTTTTACATGACTTAA
AAAGCTGTTTCGTTGTGTTTCATCCTTATATATAATTGTAATTATGCTATAATT
TTTATTGTCTGTACTTGTCCAATGATATGTTGATGTTACATCCACAAACAATG
TTTTATATTTTTGAAATCGATATCTACAACATTTTAATCTGTTAGGTTCACCTT
TTAAATGTACTACAGGCGTAGTCTTATCACCAGGGTGGTTGTTGTTGTTGATA
CTTCTACTTCTACTGTCGGTATTGTCTGTGTCGCTGATGTGTGTGTGTGTTGTG
ACACACTTTGCGTGGGACTCTCTGGAGGAGTCAAATTCTGATTCCCGTAGTCT
GGGTCGTTTTCCTGGTCTGTGGGATACTGCGGCGTCTTGGTTGCCCACGGT
TGTAAATTGCTACTTTTAAACAAGTCCTGCAATTGTTGTGTTGGCGTTTCAT
TGTTTCTATCAATATCCATATGTATTACAGAGTCCTCACTATTGTTACTATAGG
TACTGTTTTGTGAGCCTCCATTTTGTGTATTCCCGCACCCACGTCCCTGTACCT
CTTCATCTACCTGTTCTGGTGTTTCCAGAGTTTCCAATGTATTGCCATACCCGC
TGTCTTGTAGGTCTGATAAAATAAGCCTCCGTTTTACTCCTTCCCGGCACACA
GTTTGCTGATTACTAATATCCCTTAATGGACTAGCTATATACTTTCGTTTTAGT
TTTTGCAACGTCTGTTTATCTGCATGTGCTGTTTGTACTTGCAACAATTGTTGA
CTGTTTCTGCGTCTGCCTGTATATTTTGTATATATGAATCGTCTATAAATCCAT
CTAAATCTGTATCTATTTCATCCTCCTCGTCACTTTCATCATCTGATATTTTAT
CTCCTGTTTTTTTTTCTACAATTGCCTCTACTTCAAACCATCCACAACATCCCT
TCCCCTCCCCATCTGTACCTTCAGGTGACGCCATTGCAGTTAGTTACTTGATG
CGCAGAGTGGGCACGTTACTGTTAACGCACCCATAAGCAGCTGTTGTACAAC
ACGCAGGTCCTCTTTGGTACTCTGAATGTCCAACTGCACCACAAACTTACACT
CACAACAAGGTACGTGTATTAGGTAACACGTATGTTGTTTAGCTTGTCTAGCT
TGCTGTGGCCGCTCCTGCAAATGGTCTACTTCATCCTCATCCTCATCCTCTGA
GCTGTCCAATTGCTCATTGCACTGTAGGTCAATTTCTGTTTGAGGTGTTAGTTC
TAATACAACGTCTTGCAGCGTTGGTACTTTACCATGCATGATTATACTGTAGA
TTCTCTAGGTTCTCTAGATGTTTGTCTCCAGCACCCCAAACATGACCCGGTCC
AACCATGTGCTATTAGATGAAATCGTCTTTTTCTGTCACAATGCAATTGCTTTT
CCTCCGGAGTTAACGGACTTTGACATCTGTAGCACCTTATTAATAAATCACAT
AACTGTTTTTTAGTTATACTTTCTAGTGTAGCTCCATACACTGAATAGTCATA
ATACCTATATTTTCTAACTTTACTATAAAACAATAAACATACTCTGCACACTG
CATAAGGAAAATCATCCCTATACACTAATTTTAATTCAGTGCATGCAAAATTA
```

FIG. 14D

```
TATACCTCAGCACGTGTTAGTTCTTTTTTGCAATATACACATGATAATCTAAG
ATCAATTAAAGGTATTTCTAATACCTCACTCAAGTGGTGCAGGCTTCGTGGAC
GTTCCTGTGGATTGTTGAATTGTGGCTCCATGGATATGTCCACACAGAATAAG
CTGCCTTTTATATGTACCGTTTTCGGTCTTAAACCCTTTTCGGTCACTCCCAAT
ATATAAAGTATGATTGAAACTTTCAACAATTAAAAGAAACCTGTTTTTGCAC
GACCGTAAACGGTTTTAAAAAATGAGTAATTGTATGTTACATGTTTGCAAAA
CAGATACTGACAGATACTTGGCCTACATAGTGTATTCTGCAAGCCAAAACAC
CAAAGTTGCAGACACATGTATAAAAATGTGTGCCCAACAGCACTAAAGTATG
CAGATAAAAGCATAGTTGGCAGTCATAGTACCTGTGAGTAATACAGGGTGCG
GTACTGTACATAATTCAAGTATAAAACACAGGAAACGGCAATATGCCAAAGG
ATTAACTGTTCTGCTGAAAAGGGCCTTTTGGTTTAAATAATGGCACTAGGCCA
TGCAACCGAATTCCTTTTAGTTTAAATAATGGCACTAGGCCATGCAACCGAAT
TCGGTTGCATGTACAAAATGGCGGAAAAACAACAAAATGGAGTATGTTATGG
TATATATATGTATGCACAATACACATAGTACACTGTACACAATAACTTACAA
AACAAAAGCCACAATAATGACACACCTTAGTTTATGCAACCACGCGTAAAAG
CACTCATTCATGTTTATTACAGACACACAAACATTACACATATATACAGTCAT
ACATACAATGAATACACACACAAACATTTCACACAAACACAACATACACATA
CAAAGTATAAAATAAAGCACATACACAAACATACCATATATACAACACACAA
ACACAGTTACACAAACACACAACAACACACTACCGCCTTTTACGTTTTGCTG
GTGTAGAGGTGGAGGTAGGAGCAGATCGCTTTTTAGAGGTAGCTACAGCAGG
CTTTGACCTAGTGCCCAGTTGCATTAAAAATTTTCTACCCAGTGGAAATTGAT
CCAGGTCTGTAGAAAAACTGTCCTGTAAGTTAACATCCCAAAATTTATATT
GTAATTCATATTCCTCCACATGTCTAAGGTACTGATTAATTTTTCGTGCATC
ATATTTACTTAACTGTTCTGTAGCAGTACTAATAGTCATGTTAGTACTTCTAGT
AGTATCTACTACAGTAACAAATAATTGATTACCCCAGCAAATGCCATTATTAT
GGCCTTGGGCACGTTGCAACCAATAAGGTTTATTAAATAACTGTGCCTCAGA
CGTAATCATAGACCCACTAGGCGTAGCAACATATACAGAACTCGGAGGGGGT
TCTCTACCATTGCTACCCTTTAAATATAACTCTGCAGGTATTGTTTCCCCAACT
TTACCAGCCCTATTAAAATAATGTCTGGCAAATAATTGTTCCCTGCGTAAGTA
AAACCACATAGAATCACCATAGGCATCTGCAGACATTTTTAAATAGTCAGGA
TATTTACAGGTGGATTGTACAATGTCTAAAGGTACCTCAGCCTTAGATTCCTG
CAACACCTTAAAGTCCATAGCGCCAAATCCTGTGTCTATCATGTCCCCATCCT
CTATAGGTGTATTAATTAATGCAAGAGGCGGGCAGTCCCCTGTGGTAACTTGT
GTGGACTTACACACAGCACCTTTAGTCCAATGTTCACCCATAGCGGGAGTAC
ATCCAACAATACACAACTGTGTTTGCTTGCCATCAACTGATATATTGTCCCTA
CTATCTTCTATAACATTATTATTTGCTAAATTGGAACTTTCAGTATCATCCAGC
CTATTAAACAATGGATGGCCACTTAGCCCAGCACCTAAAGGCTGTCCGCGGC
CTACCTCCAAACCTACACATGCCCACACTAACCGTTCCTGGTCCGGATTATAA
ATATTAGTATCTGGAAGCCCAAACTTATTAGGGTCGGGCAACCGTACCCTAA
ATACCCTATATTGATATGCACTAACTTTGGGAATGTTTGTTTTGGTATTGTCCT
TAGTCACAGAGTAATAGGGATGTCCTACGGCAAGCAATCGTGAACTGCCTGC
ATGATAAAATATACTAGTGCGTTTTACATAGGAATCCGTTGCCACAACCTTTG
AAACAGGTGTTGGAGGTAGATACACCTTATTTTCACTAGGCCGCCACGTCGC
CATCTCGAGGGGGGGCCCGGTACCCAGCTTTGTTCCCTTTAGTGAGGGTTAA
TTGCGCGCTTGGCGTAATCATGGTCATAGCTGTTTCCTGTGTGAAATTGTTAT
CCGCTCACAATTCCACACAACATACGAGCCGGGAGCATAAAGTGTAAAGCCT
```

FIG. 14E

GGGGTGCCTAATGAGTGAGCTAACTCACATTAATTGCGTTGCGCTCACTGCCC
GCTTTCCAGTCGGGAAACCTGTCGTGCCAGCTGCATTAATGAATCGGCCAAC
GCGCGGGGAGAGGCGGTTTGCGTATTGGGCGCTCTTCCGCTTCCTCGCTCACT
GACTCGCTGCGCTCGGTCGTTCGGCTGCGGCGAGCGGTATCAGCTCACTCAA
AGGCGGTAATACGGTTATCCACAGAATCAGGGGATAACGCAGGAAAGAACA
TGTGAGCAAAAGGCCAGCAAAAGGCCAGGAACCGTAAAAAGGCCGCGTTGC
TGGCGTTTTTCCATAGGCTCCGCCCCCTGACGAGCATCACAAAAATCGACG
CTCAAGTCAGAGGTGGCGAAACCCGACAGGACTATAAAGATACCAGGCGTTT
CCCCCTGGAAGCTCCCTCGTGCGCTCTCCTGTTCCGACCCTGCCGCTTACCGG
ATACCTGTCCGCCTTTCTCCCTTCGGGAAGCGTGGCGCTTTCTCATAGCTCAC
GCTGTAGGTATCTCAGTTCGGTGTAGGTCGTTCGCTCCAAGCTGGGCTGTGTG
CACGAACCCCCCGTTCAGCCCGACCGCTGCGCCTTATCCGGTAACTATCGTCT
TGAGTCCAACCCGGTAAGACACGACTTATCGCCACTGGCAGCAGCCACTGGT
AACAGGATTAGCAGAGCGAGGTATGTAGGCGGTGCTACAGAGTTCTTGAAGT
GGTGGCCTAACTACGGCTACACTAGAAGAACAGTATTTGGTATCTGCGCTCT
GCTGAAGCCAGTTACCTTCGGAAAAAGAGTTGGTAGCTCTTGATCCGGCAAA
CAAACCACCGCTGGTAGCGGTGGTTTTTTGTTTGCAAGCAGCAGATTACGCG
CAGAAAAAAAGGATCTCAAGAAGATCCTTTGATCTTTTCTACGGGGTCTGAC
GCTCAGTGGAACGAAAACTCACGTTAAGGGATTTTGGTCATGAGATTATCAA
AAAGGATCTTCACCTAGATCCTTTTAAATTAAAAATGAAGTTTTAAATCAATC
TAAAGTATATATGAGTAAACTTGGTCTGACAGTTACCAATGCTTAATCAGTGA
GGCACCTATCTCAGCGATCTGTCTATTTCGTTCATCCATAGTTGCCTGACTCCC
CGTCGTGTAGATAACTACGATACGGGAGGGCTTACCATCTGGCCCCAGTGCT
GCAATGATACCGCGAGACCCACGCTCACCGGCTCCAGATTTATCAGCAATAA
ACCAGCCAGCCGGAAGGGCCGAGCGCAGAAGTGGTCCTGCAACTTTATCCGC
CTCCATCCAGTCTATTAATTGTTGCCGGGAAGCTAGAGTAAGTAGTTCGCCAG
TTAATAGTTTGCGCAACGTTGTTGCCATTGCTACAGGCATCGTGGTGTCACGC
TCGTCGTTTGGTATGGCTTCATTCAGCTCCGGTTCCCAACGATCAAGGCGAGT
TACATGATCCCCCATGTTGTGCAAAAAAGCGGTTAGCTCCTTCGGTCCTCCGA
TCGTTGTCAGAAGTAAGTTGGCCGCAGTGTTATCACTCATGGTTATGGCAGCA
CTGCATAATTCTCTTACTGTCATGCCATCCGTAAGATGCTTTTCTGTGACTGGT
GAGTACTCAACCAAGTCATTCTGAGAATAGTGTATGCGGCGACCGAGTTGCT
CTTGCCCGGCGTCAATACGGGATAATACCGCGCCACATAGCAGAACTTTAAA
AGTGCTCATCATTGGAAAACGTTCTTCGGGGCGAAAACTCTCAAGGATCTTA
CCGCTGTTGAGATCCAGTTCGATGTAACCCACTCGTGCACCCAACTGATCTTC
AGCATCTTTTACTTTCACCAGCGTTTCTGGGTGAGCAAAAACAGGAAGGCAA
AATGCCGCAAAAAAGGGAATAAGGGCGACACGGAAATGTTGAATACTCATA
CTCTTCCTTTTTCAATATTATTGAAGCATTTATCAGGGTTATTGTCTCATGAGC
GGATACATATTTGAATGTATTTAGAAAAATAAACAAATAGGGGTTCCGCGCA
CATTTCCCCGAAAAGTGCCACCTAAATTGTAAGCGTTAATATTTTGTTAAAAT
TCGCGTTAAATTTTGTTAAATCAGCTCATTTTTTAACCAATAGGCCGAAATC
GGCAAAATCCCTTATAAATCAAAAGAATAGACCGAGATAGGGTTGAGTGTTG
TTCCAGTTTGGAACAAGAGTCCACTATTAAAGAACGTGGACTCCAACGTCAA
AGGGCGAAAAACCGTCTATCAGGGCGATGGCCCACTACGTGAACCATCACCC
TAATCAAGTTTTTTGGGGTCGAGGTGCCGTAAAGCACTAAATCGGAACCCTA
AAGGGAGCCCCCGATTTAGAGCTTGACGGGGAAAGCCGGCGAACGTGGCGA

FIG. 14F

GAAAGGAAGGGAAGAAAGCGAAAGGAGCGGGCGCTAGGGCGCTGGCAAGT
GTAGCGGTCACGCTGCGCGTAACCACCACACCCGCCGCGCTTAATGCGCCGC
TACAGGGCGCGTCCCATTCGCCATTCAGGCTGCGCAACTGTTGGGAAGGGCG
ATCGGTGCGGGCCTCTTCGCTATTACGCCAGCTGGCGAAAGGGGGATGTGCT
GCAAGGCGATTAAGTTGGGTAACGCCAGGGTTTTCCCAGTCACGACGTTGTA
AAACGACGGCCAGTGAGCGCGCGTAATACGA*CTCACTATAGGGCGAATT*G
GAGCTCCACCGCGGTGGCGGCCGCCTGCAAAAAAATAGGGAATACGTTTACG
GCGCCTACGTCTAAAAAAATACACAGGCCATAATGCAAAGGA

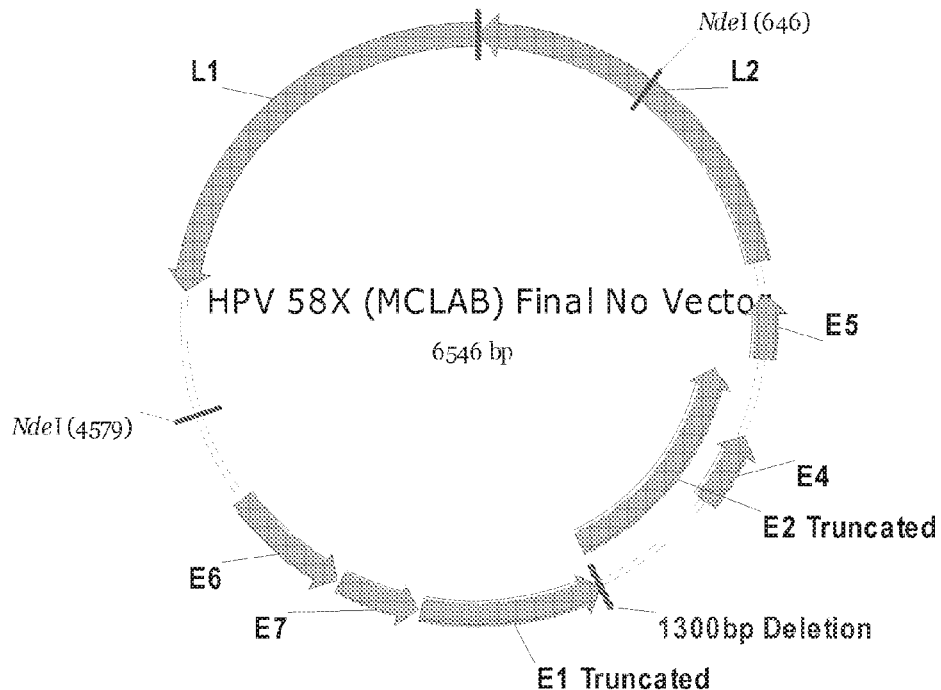

FIGURE 15A

FIG 15B
HPV 58X

Truncated Probe Sequence (SEQ ID NO: 101)

```
TCTGCAAAAAAATATGGAAAACGTTTACGTCTGCGACGCAAAATAAAATAGC
TAGGGTGCAACATAAAATCAGCACCATCCACAATTATGGTATTAAAAGGAGT
TAGTGGAGATATAGGAATAAATGGACTAGACATAGATGTTACAGAAGATGCA
ATGTCTGGACCAGGTTCCAATGACACAAGAGGAGTGTCAAATCCAGTATTTA
ATGGTATGGACACATTACTGGTACGTGTGGTGGCAAAGGACGTATGTGAGTG
CAGAGGACTCTGAAAATCATGTATAGTATCAGCATCGTCAGCATAAATATCA
TAAAGTCCATCATTAATACTATAGGGAGAAACAGAAGTATTTAAAGATTGTA
ATTCAAATTGTTGCTGCTGTTGTACCTGTTCCTGGACAGGCTGTATGGGACTT
AAGTCTTGGTAGTAATGTACTTTAGCCCCTATTTGCTTTCCACTGCGAGTACG
AAGTGTAGCCTTTTGCCCAACCCTACTATAACGTACAGTACCCCTGCGAGAG
GTTAATGCAGGTCTGTGTAATGCAACAATATCTAGAAAATCAGGATCAGGAG
CAGGCGATATGTCACTATGTTGAAACTGCAATGTGTCCTCAGGGTTAAAGCCT
TCAAATGCTGGATTATCATATGTTACAAGTCTATGAGGAGATGTTAAAAAAG
CAGGGTCAACAACCTTAACTTGTTGGGTGTTGCGACTGTATAAACCAAGGCG
TGCCACAGGGCGAGACCCTGGAATGGGTGTGCTAGACGTGACATTGCCACTG
TCAGTAGAAATAACAAAGGTATCCATTGGTATGTTTTCATAACTATGTGTGCT
```

FIG. 15C

```
AACAGTAGGAGAGGAAAATATTAAATGTCCAGAGGCCTCTGCAGGTGCAGG
AGGGCGGAGTACGGATGGCTCAGTAAAGGAGGGATTTAAATGTGTAGAAAC
AGTTTGTATAGATGATTCTCCAATAGAGGAAACATTAAGTATTGCAGGTGTA
GTATCTGCAGAGGTGGTAATATCAAAACCAGATGGAGTGGGAATTGATGGGG
CTGGTGCACCGGCGTCTATAAAACTAGATTCCTCTATTAAAGATACAATAGA
AGAATCCAAAGGCCCCACAGTATCAACGGTAACTGGGGGACGTATGGGCTGT
AAAGGTATAGCCTCAGACGGTGGGGTACTACCAAGGGGCACATATCCAGTCC
TGCCACCTGTACCCGACCCTGTACCAATGCCTAAACCTCCAAAAAACACCCC
TAAGCTACCATATCGTAATATTTGATCTGCTATAGTAGTGCCTTCAACTTTGG
GTATAACATCAGGTGGGCAGGTGCCTGAGGCCTTGCATGTTTGGTAAAGTTG
TGTAGCAGATGCACGCTTGCGCCTTGTAGACCGTTTGTGTCTCATAATAAGAC
AGTGCTAAAAATATAAAAGTATTTATTAGTAAATGTATAAAAATAATAAAAA
CAACACACACAACAGTAAATATTTACAATACCATACCACCATGTGCAGAACC
AGTATACAGTTAGTCTTGTTGGGTTAAGTATTGTGCATGAAAATTAATACACA
TCATTGGTATATATAAAAATATTAAGTAACAGAAAAAAATTCGTAGAGCCGA
CCCCACAGACACCCAAAGCAGCAACACCAACACCAGCAACCAAGCATATAT
AGAAATAGATAGCACCAATGGCCGCAAAAAAATGCACAAGCATAAAAACAG
TATAAAACAAACAACAAAAATAGGTAATATCATTGTATATACACTTAGCAGC
ACATATTGGCTTGTGGTTTACATACAGTAATTGTACAATACAATTACAATGAC
ATAACACCAGTACTTATTTGCACAGTGGGTGGTATTTTAACAGTGTTTAAAAA
CAGTTGTCGTTGTGTTTCCGTTGTGTATGTTACAGTAACAATTCCTACTTTGTC
ACCTTTGTCATCACTGGTCCAATGCCATGTGGATGACATATTACAGTATAAGT
CTTTAAATGGTTTTAATCTATATCTTAAACATTTTAAACTATTTGGGTCACCTT
TTAAATGCACGATAGGTGAAACTTTAGAACTACACACGTTCCGCCCTTTGTAT
GTACAGTTAGTTGTACTGTGTAGTCCTCCTCCTCGTGGTCTACTGTCCACGGC
GCAGTCTGTATACTTTGTGGAGTACTGGGTGTTGTCTCTGGAGTCTGGTAAAT
CGAGTCGTCGTCGCTTTGTCCCCTGTGTACTTTCGTTGTTGGTGGCCTCGGTGG
TCTTTGGGTCAGCAGTTTCAGTAGTGGATATTTGATCACTAGGTATAGATGTA
GGACATACAATTACCCGACTACCCACATGTACCTCCCATAATTGTGTTTTAGA
GTACTTTTTTGCATCCTCTTTAAAAATATTTAAAATACGTCTTTTCATTGCCATG
TATATAATACAACCCCACATAGTCAACTTCTCCTGCTACCAAAGTACATGTTG
TTTCCTCAATAATATATATTTCACTCCAATTTGTATAATCCATTGTGTTTGCTT
TATCATTGTCATATTGTACAGTTACTGTTATGCCTTTTTTTTTAAAGCATTTTT
GTGGCTCTGATAACCACACTTCTAAGCTTGTTTGTTGCAATGTCCATTCATCT
GTTTTATATGGTGATGCATTTAATGTCTCTAATGCCATTTGCAGTTCAATTACT
TGAAACGCTTTAGTCTTTGATGCTACCAATGACGGCACCACCTGGTGGCACA
AATGTGATATTCCCATTTGTCTGGCTGTATACATTATAGCACACTCCATGCGT
ATTAGTTTCCAATGTTCAATAAATGGTCTAACTAATTCCATAAAACTTACT
CCATAAGCTTCTTTGAATTTATATAATAGCGTTGCTTTAGTATTACTGTTATGT
AGAATATTACTAATATTTTGTAATGGAACAGTATTACAACTGTCTACATCCGT
TTCACTGCTTACATCTGAACTAGCCCCCACCCCACTAGACTCCGAGTCATTTA
AGTCTGCGTCGCCATTTTGGCTTTCTACCTGGTGTGCCATCTGCTCAGTTTCCA
CTTCAGTATTGCCATATCCGCTGTCTTCTAGCTCAATAATTTTTCGTTTTCTGT
GTGTGCATTCTTTATTTTTATATTTCCACGATACACACACATTTGCAGCCCGGT
CCACACAGTCCTCTACAGCACTTTCTGAGCATGCTGCAAACTTTCGTTTTAGT
GCACACACAGCATTTATATCGTCCACCCCTTCCTGTACATTAAACAACGCTCG
```

FIG. 15D

```
GGCTGCCTCTGCTTCTGCCTGTGTAGTACTTTGTACTGAATCATCTATAAACTC
TATTAAATCTGTACCACTATCGTCTGCTGTTTCGTCCTCATCATCTGAAATATT
ATCTCCTGTTCTTCGTTCTATTACCGCTTCTACCTCAAACCAGCCAGTACAGC
CCGCCCCTACCCCGTTTGTACCTTCAGGGTCATCCATTGCAGATGGTGTTTAT
TGCTGTGCACAGCTAGGGCACACAATGGTACATGTGCCCATAAGCAGCTGCT
GTAGGGTTCGTACGTCGGTTGTTGTACTGTTGATACACAAACGAACCGTGGTG
CCACAAGTGTAACAACAAGTTACAATGTAGTAATTAGCTGTGGCCGGTTGTG
CTTGTCCATCTGGCCCGTCCAAGCCTATTTCATCCTCGTCTGAGCTGTCACAT
AATTGCTCATAGCAGAATAGGTCAGTTGGTTCAGGATGTAAATCTAAAATAT
ATTCTCTTAGCGTTGGGTTGTTTCCTCTCATGGCGTTGTTACAGGTTACACTTG
TGTTTGTCTACGTCGGGGTCTCCAACACACTGCACAGCGCCCTGTCCAACGAC
CCGAAATATTATGAAACCTTTTGTTTAAATCCACATGCCTTTTTTTTTCTTGTG
GACACAATGGTCTTTGACAAATAATACATCTAATTAATATTTCATTTAAACAC
TTTTTTAGTGTTTGTTCTAATGTGTCTCCATATAGCGAATAATTATAATGTCTA
TACTCACTTATTTTAGATAGCAATCGTAAGCACACTTTACATACTGCAAATGG
ATTTCCATCTCTATACACTATTCTTAAATCTGCAAATACAAAGTCATATACCT
CAGATCGCTGCAAAGTCTTTTTGCATTCAACGCATTTCAATTCGATTTCATGC
ACAGATGTCTCCAACGCCTGACACAAATCATGCAATGTCCGTGGTTTCTCCTC
TGCGTCCTGGAACATAGTCCTGCAGTAGCCTACCAAAAAATGTCTGCTTTATA
TATGCACCGGTTTCGGTCAGACCGTTTTCGGTTACACCCTAGTTTTTACAAGA
TTTGGCATTATAGTTTAGTATTATATAAAATGTTGAAACATGAACAATGTGAC
CCAAAACGGTTAGTCCACACCTGGCAATAAATGTTAGTGAGTCACTTTTACA
AGACATAGTTTGGCATAACAAACTATTGTGCAAGCCAAAACTGCACTTAAGC
ATTGAAAGTAAGTTAAAATATGTGCCTATAAGCATGTTTAAACTATGAGTAT
AATTAAACATTTTGCAACTGCACTGCATGTATATATGAGTCACATATGCAAGT
ATAGGCAAAAGCAGTGCAGGAAGGGAAAGGATTAACTGTATTGTTTAAATTG
TAGTTTAAAAAAAACACGTTTGTGCCAGCAACCGAAATCGGTTACATGCACA
AAATGGAGGTAAAGTAAAATGGAGGCAGTACTGTTAAAAACTATAAAATAC
ATATCATACAAATACTATTACATAGGTATGCATAATAGGCAGGGCAGGGTAG
GGCAATTTAGGGACAGCACCTTACTCATAGATACACCCAAACAATACAAATA
GTTTACAATACACACAATAGTTTATTACATATATACAGAAACAGGAAACTGA
CAAGGACATAGAACATGTACACAAACATGACACATAACACATACAACATATA
CACAAACATAAACAAACAGACAACACATACATAAAACAAACAAACATGTAT
AATAAAATAGTGTAAGTACCACAACAATTATTTTTTAACCTTTTTGCGTTTGG
TGGATGGTGCACGGGTAGTAGGGGCCGAACGTTTTAGTCTGGGCTTTGCTTTA
AGGCCTGATTGTAATAAAAACTTTCGTCCCAAAGGAAACTGATCTAGATCCC
CCTCGACTCTAGAGGATCTGCAGAAAACTTTTCCTTTAAGTTAACCTCCCAAA
AAGTATATTTATTTAATGGATCTTCCTTTTCTTTAGGGGGTGCTGTTTTTTGGC
AAGTAATAGCCTGGGAGGTAACAAATCTATATGTGTCCTGTAAACTGGCAGA
CGGAGGAGGTGTTAAACCAAATTGCCAGTCCTCCAAAATATTGGAATCCATA
GTATGTATATATGTCATTATCTCTGCAGTTAGTGTAATTTTGCAAAGCTGAAA
AACAAACTGTAAGTCATATTCTTCAACATGACGTACATATTCCTTAAAATTAT
CATTTTTATATGTACCTTCCTTAGTTACTTCAGTGCATAATGTCATATTAGTGC
TACGAGTGGTATCAACCACGGTAACAAATAACTGATTGCCCCAGCAAATGCC
ATTGTTATGACCTTGTGCACGCTGTAGCCAATAAGGCTTATTAAATAATTGTG
ATTCTGAGGTAACTATAGAGCCACTAGGAGTTGGAAAAAATGCACTACTTTG
```

FIG. 15E

```
GATAACTGCAGTATTACCGGACCCTTTAATATAAAGGTCATCCGGGACAGCC
TCGCCAAGTTTTCCAGCCCTATTAAAAAAGTGTCTAACAAACATCTGCTCACG
TCTAAGAAAAAAGAACAAACTATCCCCATAAGGTTCACTGGCCATTTTTAAA
TAATCTGGATATTTGCATGTACTGTTACAAATATCAATAGGCACATCACTTTT
ATTAGCCTGCAATGTACCAAAGTCCATGCATCCAAACCCTGTATCTACCATGT
CACCATCCTCAATAATAGAATTAAAAAGTTCCAATGGAGGACAATCAGTAGC
AGCTGCATTATTGTTACAGGCAACACCTTTACCCCAATGCTCACCAGTGGGAG
GTTTACAGCCAATTAAACATAATTGTGTTTGTTTATAATCCATAGATAAGCAT
TCCCTGTTATCAGACCCTGGCTGTGCGGGATATCTGTTACTGGTTTCAGTGTC
ATCAAATTTATTTAAATAAGGATGACCACTTACGCCAACACCCAATGGCTGTC
CCCTACCTATTTCAAGGCCTACACATGCCCAGACCAAACGTTGTGTATCAGG
GTTATAAAAAGATGTATCAGGAAAACCAAATTTATTGGGATCAGGTAAACGC
ACCCTAAAGACCCTATACTGTAAGCCTGATACCTTGGGAACTAATACTTTTTT
ATTGTTATTGGGACTTTTGATGGAAAAATATGGATTGCCAACAGCCAAAAGT
CTGGAACTGCCAGCATAATAATAAATGCTTGTGCGTGACACATATTCATCAGT
GCTTACAACCTTAGACACAGGCACAGGAGGCAGGTACACAGTGGCCTCACTA
GGCCGCCACACGGACATC
```

FIGURE 16A

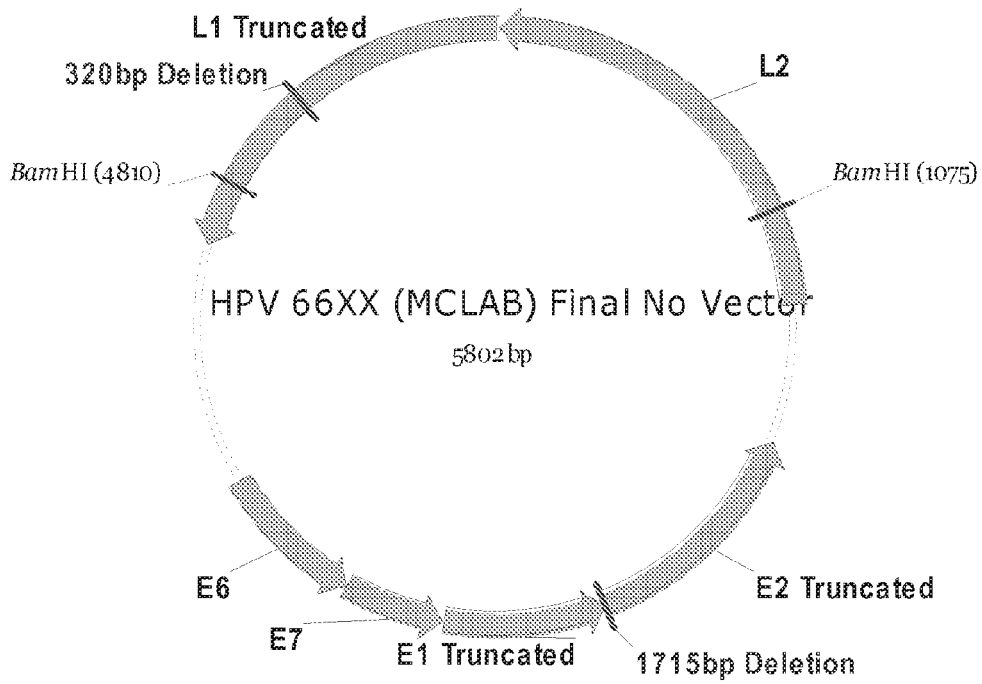

FIG 16B
HPV 66XX Plasmid

Truncated Plasmid (SEQ ID NO: 93)
Truncated Probe Sequence (highlighted) (SEQ ID NO: 102)

TCGAGGGGGGGCCCGGTACCCAGCTTTTGTTCCCTTTAGTGAGGGTTAATTGC
GCGCTTGGCGTAATCATGGTCATAGCTGTTTCCTGTGTGAAATTGTTATCCGC
TCACAATTCCACACAACATACGAGCCGGGAGCATAAAGTGTGAAGCCTGGGG
TGCCTAATGAGTGAGCTAACTCACATTAATTGCGTTGCGCTCACTGCCCGCTT
TCCAGTCGGGAAACCTGTCGTGCCAGCTGCATTAATGAATCGGCCAACGCGC
GGGGAGAGGCGGTTTGCGTATTGGGCGCTCTTCCGCTTCCTCGCTCACTGACT
CGCTGCGCTCGGTCGTTCGGCTGCGGCGAGCGGTATCAGCTCACTCAAAGGC
GGTAATACGGTTATCCACAGAATCAGGGGATAACGCAGGAAAGAACATGTG
AGCAAAAGGCCAGCAAAAGGCCAGGAACCGTAAAAAGGCCGCGTTGCTGGC
GTTTTTCCATAGGCTCCGCCCCCTGACGAGCATCACAAAAATCGACGCTCA
AGTCAGAGGTGGCGAAACCCGACAGGACTATAAAGATACCAGGCGTTTCCCC
CTGGAAGCTCCCTCGTGCGCTCTCCTGTTCCGACCCTGCCGCTTACCGGATAC
CTGTCCGCCTTTCTCCCTTCGGGAAGCGTGGCGCTTTCTCATAGCTCACGCTG
TAGGTATCTCAGTTCGGTGTAGGTCGTTCGCTCCAAGCTGGGCTGTGTGCACG

FIG. 16C

AACCCCCCGTTCAGCCCGACCGCTGCGCCTTATCCGGTAACTATCGTCTTGAG
TCCAACCCGGTAGGACACGACTTATCGCCACTGGCAGCAGCCACTGGTAACA
GGATTAGCAGAGCGAGGTATGTAGGCGGTGCTACAGAGTTCTTGAAGTGGTG
GCCTAACTACGGCTACACTAGAAGAACAGTATTTGGTATCTGCGCTCTGCTGA
AGCCAGTTACCTTCGGAAAAAGAGTTGGTAGCTCTTGATCCGGCAAACAAAC
CACCGCTGGTAGCGGTGGTTTTTTTGTTTGCAAGCAGCAGATTACGCGCAGAA
AAAAAGGATCTCAAGAAGATCCTTTGATCTTTTCTACGGGGTCTGACGCTCAG
TGGAACGAAAACTCACGTTAAGGGATTTTGGTCATGAGATTATCAAAAAGGA
TCTTCACCTAGATCCTTTTAAATTAAAAATGAAGTTTTAAATCAATCTAAAGT
ATATATGAGTAAACTTGGTCTGACAGTTACCAATGCTTAATCAGTGAGGCAC
CTATCTCAGCGATCTGTCTATTTCGTTCATCCATAGTTGCCTGACTCCCCGTCG
TGTAGATAACTACGATACGGGAGGGCTTACCATCTGGCCCCAGTGCTGCAAT
GATACCGCGAGACCCACGCTCACCGGCTCCAGATTTATCAGCAATAAACCAG
CCAGCCGGAAGGGCCGAGCGCAGAAGTGGTCCTGCAACTTTATCCGCCTCCA
TCCAGTCTATTAATTGTTGCCGGGAAGCTAGAGTAAGTAGTTCGCCAGTTAAT
AGTTTGCGCAACGTTGTTGCCATTGCTACAGGCATCGTGGTGTCACGCTCGTC
GTTTGGTATGGCTTCATTCAGCTCCGGTTCCCAACGATCAAGGCGAGTTACAT
GATCCCCCATGTTGTGCAAAAAAGCGGTTAGCTCCTTCGGTCCTCCGATCGTT
GCCAGAAGTAAGTTGGCCGCAGTGTTATCACTCATGGTTATGGCAGCACTGC
ATAATTCTCTTACTGTCATGCCATCCGTAAGATGCTTTTCTGTGACTGGTGAG
TACTCAACCAAGTCATTCTGAGAATAGTGTATGCGGCGACCGAGTTGCTCTTG
CCCGGCGTCAATACGGGATAATACCGCGCCACATAGCAGAACTTTAAAAGTG
CTCATCATTGGAAAACGTTCTTCGGGGCGAAAACTCTCAAGGATCTTACCGCT
GTTGAGATCCAGTTCGATGTAACCCACTCGTGCACCCAACTGATCTTCAGCAT
CTTTTACTTTCACCAGCGTTTCTGGGTGAGCAAAAACAGGAAGGCAAAATGC
CGCAAAAAAGGGAATAAGGGCGACACGGAAATGTTGAATACTCATACTCTTC
CTTTTTCAATATTATTGAAGCATTTATCAGGGTTATTGTCTCATGAGCGGATA
CATATTTGAATGTATTTAGAAAAATAAACAAATAGGGGTTCCGCGCACATTT
CCCCGAAAAGTGCCACCTAAATTGTAAGCGTTAATATTTTGTTAAAATTCGCG
TTAAATTTTTGTTAAATCAGCTCATTTTTTAACCAATAGGCCGAAATCGGCAA
AATCCCTTATAAATCAAAAGAATAGACCGAGATAGGGTTGAGTGTTGTTCCA
GTTTGGAACAAGAGTCCACTATTAAAGAACGTGGACTCCAACGTCAAAGGGC
GAAAAACCGTCTATCAGGGCGATGGCCCACTACGTGAACCATCACCCTAATC
AAGTTTTTTGGGGTCGAGGTGCCGTAAAGCACTAAATCGGAACCCTAAAGGG
AGCCCCCGATTTAGAGCTTGACGGGGAAAGCCGGCGAACGTGGCGAGAAAG
GAAGGGAAGAAAGCGAAAGGAGCGGGCGCTAGGGCGCTGGCAAGTGTAGCG
GTCACGCTGCGCGTAACCACCACACCCGCCGCGCTTAATGCGCCGCTACAGG
GCGCGTCCCATTCGCCATTCAGGCTGCGCAACTGTTGGGAAGGGCGATCGGT
GCGGGCCTCTTCGCTATTACGCCAGCTGGCGAAAGGGGGATGTGCTGCAAGG
CGATTAAGTTGGGTAACGCCAGGGTTTTCCCAGTCACGACGTTGTAAAACGA
CGGCCAGTGAGCGCGCGTAATACGA*CTCACTATAGGGCGAATTGG*AGCTCC
ACCGCGGTGGCGGCCGCCTGTAAAAAAATAGGGAACACGTTTACGGCGCCTA
CGTTTAAAAAAATATACAGGCCATAGTGCAAATGTACCTCCCTGTATATATAC
ATCATGTGTAACATCATAAGGAGACTGAGGTACAAAGGGCCAAGTGCTGGGG
CCTGTAGGTAAAACTATATCAGGACCAGAATAAAATGGTGTTTCCCAAACAT
TTCCCAAAGGGGCAGTAACATTAGTTGTGTTACTAGCAAAGGATAATGTAGA

FIG. 16D

```
AGGTTTAATAGGTAATTGTGCAGAAGGTGTAGCACCAGACTGACGAAATGAA
ATGGGTGCCTCATCATCAATATTTGCATAAATATCATATAGGCCATCAAATGG
ATTGTCTGTAGACAATAATGGCTGCATTTCAATTTCATCAGCCTGTGCAATAG
GACTTATATCATAATAATAATGCACACGAGCACCTATTTGTGTACCCCTACGT
GTTTGCATGGTAGCCTTTTTGCCTAGCCTACTAAAACGCACACCTGTTCTACG
TGTAGTAAATGCAGGCCTATGCAATGCAACTATATCCATAAAATCAGGATCA
GGAGCCACACCCGAGGGAGAAAAGGTCAACGTTGTGTCAGCACCTTCAAAA
ACAGGATTATCAGCAGTTATTAATGTTGTGGGGTTGTCCAAAAATGCTGGGTC
AGTGACCCTAACCTGCTGAAAAGCCCTACTATACAATCTGGGAGCAGCAAGG
CGTCTAAAACCTGGAATAGGGGTACTACTAATAGGTTCGTTGCCAGTACCGT
GTATAGCAAATGTTTGCATAGGTATTTCCTCATAGCTACGTATTCCAGATGTA
GGAGTGCTAATCAAAATATTACCAGATACCTCTCCAGTTTGTGGAGCCTCAAT
TACTGGAGGATCAATATATAGTGGGTTTGTTATAGTAGTACTACTTACATGTA
CAGTACTAGATGTGGGTGTAATATCCAACACAGCAGGTGTGGTTGTAGAAGA
GGATGTGACCTCAAAGCCCCCTGACCCAGTAAAATTGGGAACACCAGCCCCT
GAGTTAATAACACTAGATTCTTCTACCAGTGTAACAATAGAAGGATCCGTAG
GCCCAACTGACTCCACCACAATAGGTGGTCGTGCAGGAGTGACATCAACTAT
AGTAGAAGGCCTAGAGCCTAAGGGAACATAGCCCGCCCGACCACCCGACCC
AGACCCAGTACCAATGCCAAGTCCCCCAAAATATGTAAATAAACTTCCCCAT
TGTAAAATTCTATCAGCCCATGTTTTTTGCTCTACCTTATTAATAACATCCTCA
GGACATGTACCAGGTAATTTGCATGTTTTATATAATTGTGTGGCAGATGCGCG
TTTGCGTCGTGTGGCACGGTGGGCAACCATAGTAGCAAAAACGTAATACTGT
TACAAATGGTTTATTAACCACAAAGCATGAAAATATATACACAGTGTAGGTA
TATAAAAAAATAGTAAAAACAGTATAAATGTATCAAAAAATGATGTAGCCAC
AACAAACCAAAATAAAGTAATTAGTATAAGACAATTGGTAAACAAAGATGC
AGATAGCAAAAGCGGGACAAAATGGCACACACACAGACAAACACAAAAGCA
AAGCGCAAACACACAAATTACACAAATATCAATGGTTGCAATATATAGCGAT
TACACGTTACCGTTTCCAGTGTTACAATAACACATACTATACCAAATACAATT
AATGGGTGCAATATATATGCGTAGCAGCAATGTATGGCAATTACACTTCATA
TGTATCCGTGTTACAATAACACATATGTATATACAATATATACAACACTTTAT
GGACAACTCATTTGTCCCAAAATAACCTGTACACTAGGTGGTATTTTTACAAC
ATTTAAAAAGGTGTCCCGTTGCGTTTCATCTTTATATAATATTGTAATAATAC
TACTGTCTTTATTATCTGTACTTGTCCAATGATATGTTGTTGTTACATCTGTAA
ATAATGTTTTATATTTTTGAAATCTGTATCTACAACACTTTAATCTATTGGCTT
CACCTTTTAAATGAATTGCAGGTGTAGTCTTATCACCACAGTGGTTGTGTGTG
TTGATACGTGCACTTCTACTGTTGGCGTTGTTACTGATGTCTGTGTCTGTTGTG
ACACGGTGTGCGTAGGACTCTCTGGAGGAGTCAGGTTCTGATTCACTTGCTCT
GGGTCGTTTTCCTGGTCTGTGGGATACCGCGGCGTCTTGGGCGCCCACAGAG
GTGGAGGCGGTGGTGGTGGTCCTGTGGTTGTTGTATTCGTTAACAGTCTCAAC
AGGGGGTACGTTGTATCTACAGGTACTAGACACAGGGTCAGGACAATAAATA
CTCTCGGTTTCCATATGTACTTCCCATATGTTTGTACACCCATATTTTTTGGCC
TCCTGTTCAAAGTCTGTGTAATATGTTTTGTGGCCATCATGCATATAATATAT
GCCTCTGTAATCCACCCCTGATGACACTTTACACCACCCACACTCTCCATTAT
AATATATAAATTTCCACACCACATATTCCATACAATTATTTTTGTTACC***TC
CATATTTGTATCTATATCCATATTTACCACCGAGTGCTCACTACAGTTACTGTT
TTGCGAGCCTCCATTTTGTGAGCTCCCGCACCCATTTCCCTTTTCGTATTCTAC
```

FIG. 16E

```
CTGTTGTGATGTTTCCAATGTTTCCAATGTATTGCCGTACCCGCTGTCTTCTGA
TAATATTAGCCTTCGTTTTACTTCCTCCCGGTACACAGTTTGCTGATTACTAAT
ATCACTTAAGGGACTACCTATATACTTTCGTTTTAGTTTTTGCAACGTCTGTGC
ATCTGCATGTGCTGTTTGTACTTGCAATAATTGTTGAGCTGTCTCCCTGTCTTC
CTGTGTATTGTTTATAAGTGTATTGTCTATAAATCCATCTAAATCTGTATCTGT
TTCATTCTCCTCCTCGCTTTCATCATCTGATATTGTATCCCCGTTTTTCTTTCT
ACAATTGCTTCTACCTGAAACCATCCACAACATCCCGTCCCCTCCCCATTTGT
ACCTTCAGGTGATGCCATTGCAGTTATTTAGTTGACGCGCAGAGTGGGCACGT
TACTGTTAACGCACCCATAAGCAGCTGTTGTACCACACGTAGCTCCTCTTTGG
TACTCTGAATGTCCAACTGCACCACAAGCTCACACTTACAACAAGGTACGTG
AATTAGGTAACACTTATGTTGTTCAGCTTGTCTAGCTTGCTGTGGCCGCTCCA
GCAAATGGTCTATTTCATCCTCATCCTCATCCTCTGAGCTGTCCAATTGCTCAT
TGCATTGTAGGTCAATTTCAGTTTGCGGTGCAAGTTCTAATATAATCTCTTGC
AACGTTGGTGCTTTACCATGCATGGTTATACTGTAGATTCTGTGGCTTGTCTA
CTCGTATGTCTCCAACACTGCAAACATGACCCGGTCCATGCATATGCTATATA
ATGAAATCGTCTTTTATGTTCACAGTGCAATTGTTTTTCCTCCGGTGTTAACGG
ACATTGACATCGGTAGCACCTTATTGATAAATCAGATAACTGTTTTTAGTTAT
ACCTTCTAATGTTGCCCCATACACTGAATATTTATAGTACCTATATTTTCTAAC
CTTACTATAAAACAATAAACATACCCTACATACTGCATATGGCCAATTGTTTC
TATATACTAATTTTAACTCAATACATGCAAACCTATATAACTCTAAACTTGTA
AGTTCCTTTTTGCAGTATACACATGATAATCTAAGATCAAGTAAAGGTATTTG
TAATACCTCGCTCAGATGGTGCAGGCTTCGTGGACGTTCCTGTGTATTGCTGA
ATATGGAATCCATGGATATCTACAGGCACAACAGGCTGCCTTTTATATGTACC
GTTTTCGGTCCTAAACCCATTTCGGTTACTCCCAATATAATAAAGTATGATTG
AAACTTTCAACAATTAAAAGAAACCTGTCTTAGCACGACCGTAAACGGTTTT
GAAAAATGAGTAAGTATATGGTTACATATTTGCAAGACAGATACTTGGCTTA
TACAATAAGGGCTACACGCCAACAAAATATATTGCAAACACCTGCATAAAAA
CATATGCCCAACAGCGCCAAAGTATGCAGATAAAAGCATAGTTGGCACAGAA
ATACTGGTGAGTAATACAGGGTAAGGCAGTGTACATACCTGAATCATACAAC
AGGAAACGGCAATATGCCAAAGGATTAACTGTTTTGCTGAAAAGTCGTTTTG
GGTTTAAATAAGGACAAAAGGCTAGGCAACCGAATTCGGTTGCATGCATAAA
ATGGCGTACAGCACTAAAATGGAGTTTGGTATGTTACTATAGTGCATACAAA
CAACCTATTTAATATAACAGTAAACAGTAAGGAACACCACCTAACCTGACAC
ACACTGCCCAAGGATACTACCGCACCTTAGTTTATGCAACCACGCGTAAAAG
TAACCATGCATGTTTATTACATACACACAAAACATTACACATACATACAGTCA
TACATACACATAGCACATACACAATTATAAAATACATAAACATACACAAAAA
CATACAGTACAAGCACAACCATACAATACATACAACAGACAACACACAACT
ATCGTCTTTTACGTTTAGCTGGTAAAGAAGAGGAAGAGGTAGGAGCCGCCCG
CTTTTTAGAGGCAGATGCACTAGCCTTGGGTCTAGGGCCTAGTTGCATTAAAA
ATTTTCTACCCAAAGGAAACTGATCTAGGTCTGCAGAAAAGCTGTCCTGTAA
ATTAACCTCCCAAAACTTATATTTAGCCAGGGGATCCTGCTTTTCTGCAGGGG
GCTGTTCCCTTTGACATGTAATAGCTGTGCTTTTAATATGCCTATATTTATCCT
CTAAGCTAGTTGCAACTGGTGGGGACAATCCAATGTTCCAATCGTCTAATAA
AGTATTATTCATATTATGCAAATATGCCATAACTTCTGCAGTTAAGGTTATTT
TACAAAGTTGAAACACAAACTGTAGTTCATATTCCTCCACATGGCGAAGGTA
TTGATTGATTTCACGTGCATCATATTTAGTTAATGTGCTTTTAGCTGCATTAAT
```

FIG. 16F

AGTCATGTTGGTACTTCTGGTAGTATCCACAACAGTAACAAATACCTGGCA
CCTCAGCCTTTGATTCCTGTAATTGCTTAAAGTCCATTGCACCAAACCCGG
TGTCCACCATGTCACCGTCCTCTATTGGGGTATTAACTAATGCCAAAGGTGGA
CAATCCCCTGTATTGACTGGTGTAGACTTACACACCGCGCCCTTAGTCCAATG
TTCACCTAATGCTGGCGCACATCCCACAATACATAACTGGGTTTGTTTACAAT
CAACAGATATATTGTCCCGGTTATCTTCTGCAACATTATTACTTGCTAAATTA
GAGACTTCAGTGTCATCCAGCCTATTAAATAATGGATGACCACTTAACCCAG
CACCTAAAGGTTGACCTCGGCCTACCTCCAAACCTACACAGGCCCATACCAA
ACGTTCCTGGTCAGGATTATAGAAAGATGGATCAGGAAGGCCAAACTTATTA
GGATCAGGCAACCGTACCCTAAACACTCTATACTGATATGCACTAACTTTAG
GGATGTTTGTTTTGGTACCAGATTTAGAAACAGAGTAATAAGGATGGCCAAC
AGCAAGCAACCTAGAGCTACCTGCATGATAAAATATACTGGTACGTTTTACA
TATGTATCCGTTGCCACAACCTTTGAAACAGGTGTTGGAGGTAGGTACACCTT
ATTGTCACTAGAACGCCATAGAGCCATC

FIGURE 17 A

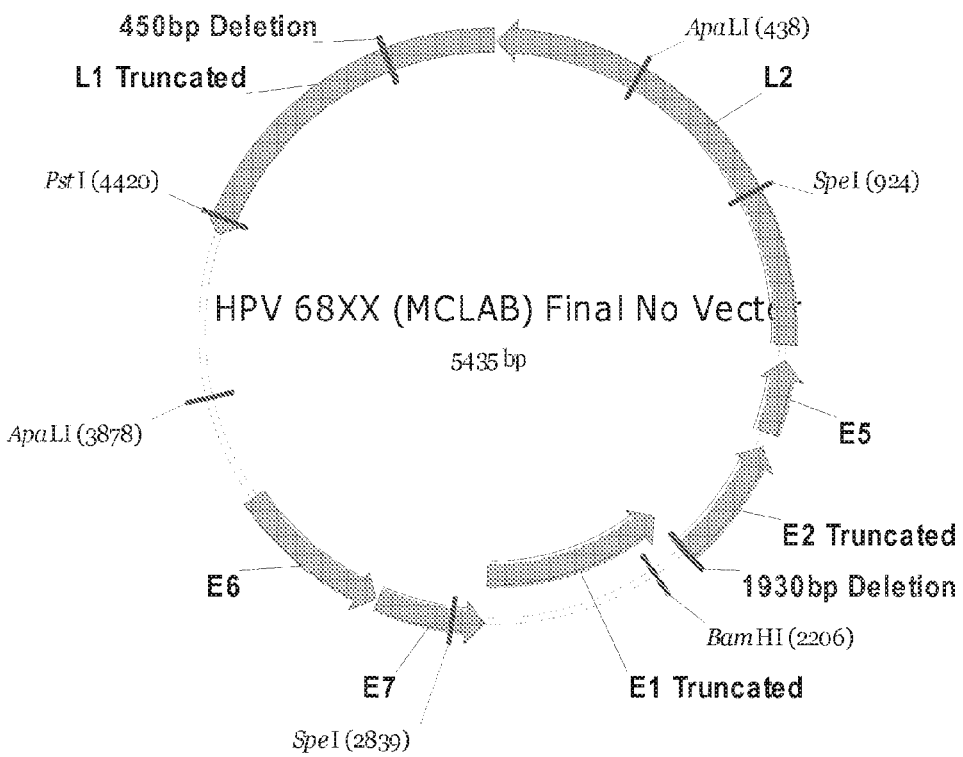

FIG 17B
HPV 68XX Plasmid

Truncated Plasmid (SEQ ID NO: 94)
Truncated Probe Sequence (highlighted) (SEQ ID NO: 103)

```
TAATTGCTGCTGATTGTAGGTAGCGGTATGTATCTACAAGACTAGCAGATGGT
GGAGGGGCAACACCAAAAATTCCAATCATCCAAAATAGCAGGATTCATAGTAT
GTATATATGACATTACATCAGTGGATAATGTTATAGTACACAACTGAAATAT
AAACTGCAAATCATATTCCTCAACATGCCTAACATATTCCTTAAAATTTATTAG
AATCATACACAGCTGGTACAGTAGAGTCTGTAGTAGTGGACAATGTAAAATT
AGTACTGCGCGTTGTATCCACAACGGTAAGAAATAATTGATTATGCCAACAA
ATACCATTGTTGTGTCCCTGTGCCTTGTGCAGCCAATAGGGCTTGTTAAATAA
CTGGGAGTCAGAGGACACCATAGACCCGCTAGGCGAGGGGGCATACACATA
ACTACTAGGAGTTTCACGAATGTCAGTGCCCTTAATATACATGTCAGTGGGA
ATAGTGTCCCCTACCATGCCTCCCCATTCCAAAATGCCTGATTTCAACACC
AACACAGGCCCATACCATGCGCTGTGTATCTGGATTATATAATGTAGACTCA
```

FIG. 17C

GGAACACTAAATTTATTAGGATCNAGGTAAGGTAACCCTAAACACTCTGTAT
TGATATGCAGACACCTTAGGAATGCCCTGCTTGCGGCCCCAGACATAGGAA
CCTTAAAATATGGATGGCCTACAGTTAATAACCTAGATGTACCAGCATAGTA
ATACATGCCAGTGCGTGTCACATAATCATCTGTATTGACAACCTTCGCCACTG
AGGGGGGAGGCAAATACACCATGTTGTCGCTAGCTCGCCACAATGCCATCTC
GAGGGGGGGCCCGGTACCCAGCTTTTGTTCCCTTTAGTGAGGGTTAATTGCGC
GCTTGGCGTAATCATGGTCATAGCTGTTTCCTGTGTGAAATTGTTATCCGCTC
ACAATTCCACACAACATACGAGCCGGGAGCATAAAGTGTAAAGCCTGGGGTG
CCTAATGAGTGAGCTAACTCACATTAATTGCGTTGCGCTCACTGCCCGCTTTC
CAGTCGGGAAACCTGTCGTGCCAGCTGCATTAATGAATCGGCCAACGCGCGG
GGAGAGGCGGTTTGCGTATTGGGCGCTCTTCCGCTTCCTCGCTCACTGACTCG
CTGCGCTCGGTCGTTCGGCTGCGGCGAGCGGTATCAGCTCACTCAAAGGCGG
TAATACGGTTATCCACAGAATCAGGGGATAACGCAGGAAAGAACATGTGAG
CAAAAGGCCAGCAAAAGGCCAGGAACCGTAAAAAGGCCGCGTTGCTGGCGT
TTTTCCATAGGCTCCGCCCCCTGACGAGCATCACAAAAATCGACGCTCAAG
TCAGAGGTGGCGAAACCCGACAGGACTATAAAGATACCAGGCGTTTCCCCCT
GGAAGCTCCCTCGTGCGCTCTCCTGTTCCGACCCTGCTGCTTACCGGATACCT
GTCCGCCTTTCTCCCTTCGGGAAGCGTGGCGCTTTCTCATAGCTCACGCTGTA
GGTATCTCAGTTCGGTGTAGGTCGTTCGCTCCAAGCTGGGCTGTGTGCACGAA
CCCCCCGTTCAGCCCGACCGCTGCGCCTTATCCGGTAACTATCGTCTTGAGTC
CAACCCGGTAAGACACGACTTATCGCCACTGGCAGCAGCCACTGGTAACAGG
ATTAGCAGAGCGAGGTATGTAGGCGGTGCTACAGAGTTCTTGAAGTGGTGGC
CTAACTACGGCTACACTAGAAGAACAGTATTTGGTATCTGCGCTCTGCTGAA
GCCAGTTACCTTCGGAAAAAGAGTTGGTAGCTCTTGATCCGGCAAACAAACC
ACCGCTGGTAGCGGTGGTTTTTTTGTTTGCAAGCAGCAGATTACGCGCAGAA
AAAAGGATCTCAAGAAGATCCTTTGATCTTTTCTACGGGGTCTGACGCTCAG
TGGAACGAAAACTCACGTTAAGGGATTTTGGTCATGAGATTATCAAAAAGGA
TCTTCACCTAGATCCTTTTAAATTAAAAATGAAGTTTTAAATCAATCTAAAGT
ATATATGAGTAAACTTGGTCTGACAGTTACCAATGCTTAATCAGTGAGGCAC
CTATCTCAGCGATCTGTCTATTTCGTTCATCCATAGTTGCCTGACTCCCCGTCG
TGTAGATAACTACGATACGGGAGGGCTTACCATCTGGCCCCAGTGCTGCAAT
GATACCGCGAGACCCACGCTCACCGGCTCCAGATTTATCAGCAATAAACCAG
CCAGCCGGAAGGGCCGAGCGCAGAAGTGGTCCTGCAACTTTATCCGCCTCCA
TCCAGTCTATTAATTGTTGCCGGGAAGCTAGAGTAAGTAGTTCGCCAGTTAAT
AGTTTGCGCAACGTTGTTGCCATTGCTACAGGCATCGTGGTGTCACGCTCGTC
GTTTGGTATGGCTTCATTCAGCTCCGGTTCCCAACGATCAAGGCGAGTTACAT
GATCCCCCATGTTGTGCAAAAAAGCGGTTAGCTCCTTCGGTCCTCCGATCGTT
GTCAGAAGTAAGTTGGCCGCAGTGTTATCACTCATGGTTATGGCAGCACTGC
ATAATTCTCTTACTGTCATGCCATCCGTAAGATGCTTTTCTGTGACTGGTGAG
TACTCAACCAAGTCATTCTGAGAATAGTGTATGCGGCGACCGAGTTGCTCTTG
CCCGGCGTCAATACGGGATAATACCGCGCCACATAGCAGAACTTTAAAAGTG
CTCATCATTGGAAAACGTTCTTCGGGGCGAAAACTCTCAAGGATCTTACCGCT
GTTGAGATCCAGTTCGATGTAACCCACTCGTGCACCCAACTGATCTTCAGCAT
CTTTTACTTTCACCAGCGTTTCTGGGTGAGCAAAAACAGGAAGGCAAAATGC
CGCAAAAAAGGGAATAAGGGCGACACGGAAATGTTGAATACTCATACTCTTC
CTTTTTCAATATTATTGAAGCATTTATCAGGGTTATTGTCTCATGAGCGGATA

FIG. 17D

CATATTTGAATGTATTTAGAAAAATAAACAAATAGGGGTTCCGCGCACATTT
CCCCGAAAAGTGCCACCTAAATTGTAAGCGTTAATATTTTGTTAAAATTCGCG
TTAAATTTTTGTTAAATCAGCTCATTTTTTAACCAATAGGCCGAAATCGGCAA
AATCCCTTATAAATCAAAAGAATAGACCGAGATAGGGTTGAGTGTTGTTCCA
GTTTGGAACAAGAGTCCACTATTAAAGAACGTGGACTCCAACGTCAAAGGGC
GAAAAACCGTCTATCAGGGCGATGGCCCACTACGTGAACCATCACCCTAATC
AAGTTTTTTGGGGTCGAGGTGCCGTAAAGCACTAAATCGGAACCCTAAAGGG
AGCCCCCGATTTAGAGCTTGACGGGGAAAGCCGGCGAACGTGGCGAGAAAG
GAAGGGAAGAAAGCGAAAGGAGCGGGCGCTAGGGCGCTGGCAAGTGTAGCG
GTCACGCTGCGCGTAACCACCACACCCGCCGCGCTTAATGCGCCGCTACAGG
GCGCGTCCCATTCGCCATTCAGGCTGCGCAACTGTTGGGAAGGGCGATCGGT
GCGGGCCTCTTCGCTATTACGCCAGCTGGCGAAAGGGGGATGTGCTGCAAGG
CGATTAAGTTGGGTAACGCCAGGGTTTTCCCAGTCACGACGTTGTAAAACGA
CGGCCAGTGAGCGCGCGTAATACGA*CTCACTATAGGGCGAATT*GGAGCTCC
ACCGCGGTGGCGGCCGCCTGTAAAAAATAAGGAAGGTGTTTACGTTTTTTT
AATAAAAAGAATAACAATGGTAATAAATAATAATTGGAACCATATATAGTTA
TGGCAAAGGTTGTATCAATTGGAGTAGAGGGTGTTAAAGGCAACTGTGGGGT
TGTAGATGGTAATACAACATCAGGACCAGTATTTACAGGCGTGTTCCAAGCA
GTACCAAGAGGAATGGTAGTATTAGTATATGTAGTGGATGCAGCAGAAGCCA
ATGAAGGAACTGATATGTGGGAACGAGTAGTAAATGTAGCATTATGAAATGC
AGTATCTAATACTGTAGTATTGTCAGTATCAGGTGCATATATATCATATAAGT
TATCCATAGGGTCCGCCTGCTCAGGGGCAACCAATGGTTGTAGTTCAATGCTG
TCAGCAGGGGTAATGTTACTAATATCATGATAATAGTGCACCTGTGCCCCAAT
TTGTGTACCTCGGCGTGTAAACATGGTCGCCTTTTTGCCTACTCTGCTAAAAC
GTACTGTTCCTCTTCGGGATGTTAAGGCAGGCCTATGTAAACGAACAATGTCC
AGAAAATCCGGATCAGGAGCTATGTCAGCAGGTTCATATGTAAGAGTAGTAT
CAACAGGCTCAAAAGCAGGATTATCAAATGTTACAAATGATGAAGGGTGCGT
TACAAAATCAAAATTACTAACACGAACCTGTTGATGTGCCCTACTATATAAA
CGTGGCCCTGCCACACGACTAACCCCAGGTATAGGAGTACTACTAATAGGTT
CTGTACCAGTGCCATGTGTTGCAAATACCTGCATAGGTATTTCCTCATATCCA
TGTGTTCCTGATGTAGGGGTACTTACAAACACATTACCAGACACCTCACCTGT
TTGTGGCACTTCTATTATAGTCGGGTCTGTAAATGCAGGGTTAGTAAAACTAG
TACTGCTTACCTGCACAGACCCGGACGAAGGGGTAATGTCTAAAACTGCCGG
TGTAGTGGTAGACGAAGATGTAATTTCAAACCCAGAGGTGCCTGTAAATGTT
GGTACTGGTGTCCCAGATGTAATAACACTGGAATCCTCCACCAATTGCACAA
TGGAGGGTTCCGTAGGACCCACAGGTTCAATAACCACAGGTGGACGTGCAGG
CGACACATCCACAACAGTATTAGGTTTTCCACCTAAAGGAATGTACCCAGCA
CGACCTCCGGTGCCAGAGCCAGTACCTATACCCAGGCCACCCAAAAATATAC
CTAAACTTGTCCATTGTAATATTTTGTCTGCAAGTGTAGTACCTTCAACCTTAT
TTATAACATCAGAAGGACATGTCCCTGATTGTTTACATGTTTTATATAAGTCA
GTTGCAGATGCACGCTTGCGCCTGGCAGCACGGTGTGAAACCATATTTATTTA
TACAAATAAACAACAATACAAATGCACACTATAACAGTTACTGTATAGTATT
AAGAGTAAGACTGTGTAATAACCACATAGGCAGTATAAAAAAAAGTAGGTA
TACAGCAAACACCTCAAATGGTGTAGTTCTAACTAATATAAACACAAACACA
AATATCCACACATACACACACACATGCACAGACTGCAAAAGCGGGACAGTG
CAACATATATACATGCATACACAAAACCACACCAAAAATACCAATACAAGCA

FIG. 17E

```
TATGTATACAATATACATATAGTGTACAGTGTGGGTCAATACACACTTATAAT
GTCATATACCCCAATGACACAGTTACACTAGATGGTAGTTTAACAGTTTCCAA
AAACTTGTCACGTTGTGCTTCTGAAACATATGTTACAGTCAATATACCTGTAT
TGGTTGATCCCCTACCCCTTATCCAATGCCATGTACATGATATATTGTCATAC
AAAGCGTTATGTTTTTGCAACCTATACCTAAGACATTTTAATCCATTTTTGTCA
CCTTTTAAATGCACTATAGGTGTAGTGTCACCACAACAAAGGCTCCGTCTTTT
GTTTTGGCCTGCACTTCTACTGAGGAGTGGGAGGTCGACACCGTCCACGGAC
ACGTTGTCGGGCTCAGAGGGCTCAGTGATTCCGCACTGTCTGGGATACTCC
GAGACGACGTCGTACGTACCAGGTCATTAAATGACAATCCATATACTTTT
TTAAATTCTGTTAACATTGCAGCCTTTTTATTGTTACATTGTAATAATACTTTA
AGTTGGGTAGTAGGTGATTTAGGATCCTGGTTTTCACTATCTATAGCACTGTC
CACACTACTACAGTCCTCCCGTATACTGTCGCCATTTTCCCCTTCATTTTCCCC
ATCCTCCCCATTTATATTAGGTGCTACAGTTACCTCCGAGTTAGTTTCCACTTC
CATATTGCCATAGCCGCTGTCCGGCACTGTATACGCCGGTTGTCTTGCCTGTG
TACTGCTTACATTTAGTGATAATTCCTGTAATGGCGACTTTGCTAAAGGACTG
CTTTCTATACTGTCTGTATACTTTCGTTTTAGGGCACGCACCCTTTGTGCATCC
CTTTGGGCCTCTTGCATATTCAAAAGTACCTGTGCTGTCTCACGCTCTGCCTGT
ATACAAATATGTGTAGAATCATCAATAAAATCTACCATGTCTGAACCTGTATC
TGTTGCGTTTTCGTCCTCATCCTCTGAGACTGTGTCACCTGTTTGTTTATCTAC
TATTGCTTCTACAAAAAACCATCCGTTACACCCCGTCCCGTCCCCATCGGTAC
CTTCACAATTGGCCATTGCAGATTACTGGGTTTCAGTTGCACACCACGGACAC
ACAAAATTTAGTGAGTCCATAAACAGCTGTTGTAGTGTCCGCAGGTTGTCCCG
CGACGCTTCTACTACTAGTTGCAGTGCCTTGTTACACTTACAACACAGACACG
CGTGACGCTGTTGTTCGTCCCGTCTGGCTAGTAGTAGATGTTGGTGGTGATTA
ACTGCATGGTCGGGTTCATCTATTTCATCGTCTGAATCTCCTAATTGCTCGTG
ACATACAAGGTCAACCGGCTGTATTTCATTGTATGGACATAGCTCTAACACA
ATTTCCTGCACGGTGGGCTTTGGTCCATGCATAGTTACTTAAACTTGTGTTTCT
TGACGTATGCGTCTGCGGTCCTCTCGCTTACTGGTCCAGCAGTGCCGACACTG
TCCTGTAAAGTTTCCTGCTATTTTATGTAATCTTCGTTTTGTTGTTAGGTGCCT
TAGTTTTTCTGCTGGACACAATGGTTTCAGGCAACTCATGCACCTTATCAATA
AATTATATAACTTTGTATTAGTTATGGTTTCTAATGTAGTTGCATACACCGATT
CCGAGTAATATCGTAGTTCCCGTATTTTAGCATAAAATTTAATACATGATTGG
CATGCAGCAAATGGTACCCCGTCTCTATACACTACACATAGGTCACTAAAGG
CAAATTCATATACCTCTGTCCGTTGTAGTTGCCTTCTGCAATAGACACAGTCT
ATTGTAACGTCATGCAATGTAGTGTCCAATGTCCTGCACAGGTCTGGCAATTT
GTATGGCCGTTCCTCAGGGTTGTGAAATAGCGCCATTAGTATAGAGAACTGC
TGTGTTCAGCTTTATATACACCGTTTTCGGTCGTGACCGTTTCGGTCCCACCC
TTTTTTTATATAGAATAATTGTAAAATGTTATAAGTAAAAGTATTGGTATGTG
TGCCCAACCTTTTTCGGTTGCACAAATTTATGGATGTAGTATTAGTCACTGTA
TAACTTACACTACCAGACAGATTCTTGAATGCAAAAGTAGTTATACTGGCCA
ACTATGCTATTAGGCAAGCAAAAACAGTTAAAACTTTATGCCTAAAAGCAGT
TTTATTACAAGGGAGGAGATACGTTGGTTGCCAAACTATTGTTGCAGTGCACC
TGGACAGGATGATGACTAACTAAGGTGCGCCAGTACGACTGTTACTGGTGCC
AACTATGTGGGTAACTCAAGGTAAAACATGTTTTTGCTGAAACACATAGGTTT
TAATACTATCTAAAAGCAAATAGTACCAACGACCGAAAGCGGTCGCACACAA
CCCGGCCATACAAAATGGCCACACGGTATAGTTTGCAACCATAAATATATTG
```

FIG. 17F

```
CATATAATGTAACACACCTTAGGGTAGGGCTACAAATTATGTATGAAATGTT
GCAGTCCTATTATATGTAAAACAAGGACATATGTTAGTCACAGGGTGCAACC
ACAAAGGACACGGACATACATACTTTATTAACAAAAACAGATTATACACACA
TACTTGCAAACATACACATATACACATACACATACATGCACATACACAACAT
ACCAACACCAACATGACACATATACAACCACACAGACAAACAACATACAAA
ACAAGACATATAACAATTATTTTGACACACGTTTACGTTTGTGTTTAGAGGTA
GATGTGGTAGCTGCAGTGGCAGTGCGTTTACGAGGGCCTATGGTGGGCCGTC
TGCGAACACCTGCCTGTAACAGAAATTTGCGTCCTAATGGGAATTGGTCCAG
TTCAGAACTAAACTTTTCCTTTAAATCCACATTCCAAAAGTTAAGACCATCAT
AGGGATCTTTTTTAACAGGTGCAGGGGCGTCCTTTTGACATG
```

FIGURE 18A

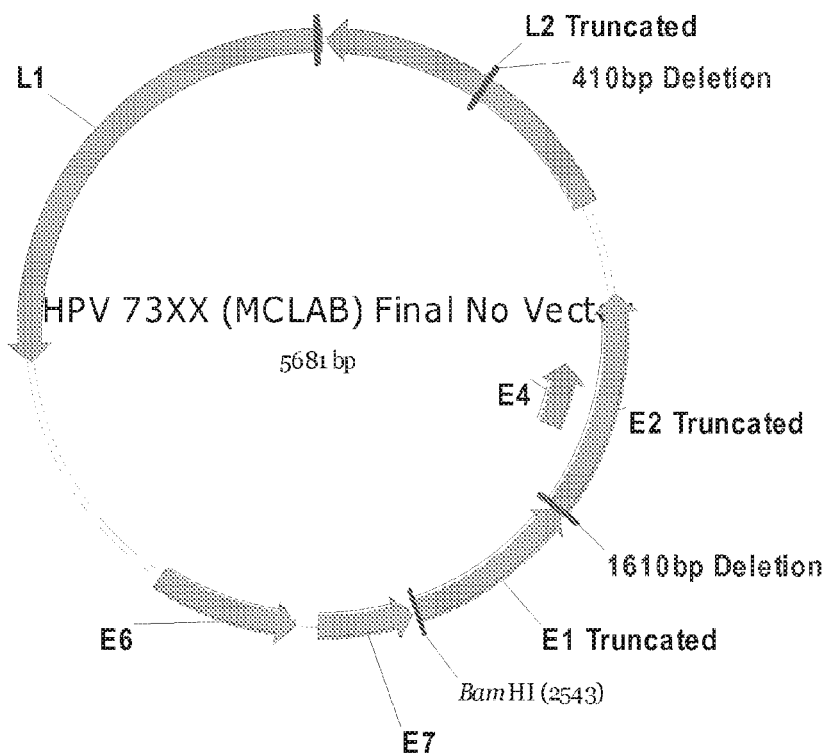

FIG 18B
HPV 73XX

Probe Sequence (SEQ ID NO: 95)

GATCCCCTGTTTTTCTTTCTACAATGGCTTCTACATTAAACCATCCCGTACACC
TCCCTTCCCAATTACCTGAATCAGCCATCTTCTTTTATAGGTTTCTGGAACAGT
TGGGGCACACAATACCTAGTGTACCCATAAGCAACTCTTCTATCACTCTTAAA
TCAGCTTTGTTGCTTTCAATGGCAAGGCATACTGTGCACTGACACTTCGTGCA
GTCAGTAACTATTCTGTAACACTCTCGTTCAGCTTGTCTGTCTAGATGGCTGT
CTGTTTCATCCTCATCCTCTGAGTTGTCCAATGACTCGTAACATGTAAGGTCA
ATTCGGTTGTTGGTTTCAGGTCTAAAGTAATGTCCTGCAAGGTTGTTTTTTTT
CCATGCATCTTACACCACAGTTGCAGATGGTCTCCAGCACCGTGTACAGCGTC
CGGTCCACTGTTCTGCTATTTGATGAAACCGTTTTTTTTCATCTACATGCTTTT
GCTTTTCCAGTGGACATAATGGTTTTTGGCATTTTCCGCACCTTATTAAAATAT
TACATAACTGTTTGTTAGTTAAATTTTCTAACGTAGTGCCATATACTGATTGTC
TATATCGCCTATACTCTCTAATTTTAGAATAAAATTTTAAACACGGTTGACAT
ACACCATATGGTTTATCCTTTCTATATACAATACACAAATCACTAAATGCAAA
ATCATATACCTCAGATCTGTACAGTCCACGTTGGCAAAACACACAGTCCAGG

FIG. 18C

```
TTTATATCATGTATAGAAATATTCACTTCGTCACATAACGCTTGTAGCTTGTA
TGGTCGTTCTTCTGAATTGGGAAACAGCATTTCCCAATCTGTAGCGTTTTTG
CTTTCCTACTTTTATATGCACCGATTTCGGTTGAAACCGTTTTCGGTTACACCC
TTTTTTTTAATAGTACATTATAGTTATTTGTAATAAGAAATAAATTGGCATTTG
TGTGATCCAAATAGGTTTAACTTTTTAGGTGCAGTATGAGTAACACGTTATTA
CTCATTTATAAACAATTACTTGGCATTTAAAAAACAATGTTCTGCCAAGAGT
ACACTGTGTACATAGTATAGGTATGTGCTTAAAAGCAATTTTATGATAGGGTG
GGTAAAAAATGTGTGTGCAAGACATTGTTTAAATAATTGCAGACAAATGAGT
AACTGCCAGGTGGCGCCTTTTACCTTTATAACCTTGCGTGGGATGAACATGTT
AAGGAAACAAACCCTGCCAAGTTGCCTGCAGGAAGCCAAAAACAGTACAAC
TATTTTGCTACAACAGCAAAACACATTAAAACATGTTTACTGTGCAACCGAA
ATCGGTTGCCCTTTTACCTTAATGCATGTAAAATGGCGACTATACAAAATGG
AAGCACAGTAGTCAAGTAAACCACCCACACAACACACATATAAACTTTATTA
AACATACATACAAACATTACTACACATACACATACACATACACATACACACA
AATACATACATATATATAAACAAACAGTTATACACATGTACATAAACATACA
CACAGTATTAGTAAACAGTTAACATACAACAAACAAACATACAAAACACATG
TAACATACAACAAACAACACATACACATTACACTTATTAAATACGTTTAGCA
CGTTTTTTCTTAGGTGTGGCACTTGTGGTAGCAGATGCAGAACGTTTAGAAGC
TTGTAACTTAGGACGTGCACGCATACCAAGTTGTAATAAAAATTTTCTTCCCA
AAGGAAACTGGTCTAATTCTGCAGAAAACTTTTCCTTAAGATCTACATCCCAA
AAGGATAGCTTGGCATATGGGTCCTCTGTTTCTTTAGGAGGTTGAGGACGTTG
GCAACTAATAGCCTGTGATGTTACATATCTATATGTTTCCTCTAAAGTACCTG
ACGGTGGTGGGGTAAGACCAAAATTCCACTCTTCCAATATAGTAGAATTCAT
AGAATGTATATATGTCATTACCTCAGTAGTTAAACTAATTTTACATAACTGAA
AAACAAACTGTAAATCAAACTCTTCTGCATGTCTTAAATATTCCTTAAAATTA
GAGTTGGCATACGTTGTAGTAGAGCTACTAGCCTGTGTACCTACACATACAG
AAAAATTAGTGCTTCTAGTAGTATCTACAACAGTTAAAATAATTGATTATGC
CAACAAATACCATTATTTTGTCCCTGTGCCTTTTGCAACCAATAAGGTTTATT
AAACAACTGTGCATCTGAAGAAACCATGGAACCACTAGGTGTAGGATAAAA
AACACAACTGGATGGTGTTGCAGTATTGCCTGTGCCTTTAATCATTAGGTCAT
CTGGGATTTTATCACCGGTATCACCAGCCCTGTTAAATAAGTGTCGAACAAAC
ATTTGTTCCCTACGAAGATAAAACCACATGGAATCACCATAGGGATCAGCAG
CCATGCCTAAATAATCTGGGTATTTACAGGTAGTGTTAGAAATATCAATAGGT
ACATCACTTTTATTTGCTTGTAAAGCTTTAAAATCCATGGCTCCAAAGCCAAC
ATCTATCATATCACCATCCTGTATAGGGGTGTTCTTTAATTCCAGTGGGGGAC
AATCACCAGTATTAACAGTTTGTGAAGTACATGGCGTGCCTGGACCCCAATG
TTCCCCTAAGGGAGGCCTACAACCTAAAATACACAACTGTGTTTGTTTATAAT
CCACTGACATACATTCTCTACCATCTGTATTTTGTCCAGCAATGTATTTAGGA
GCATTTTCAGTATCATCTAATTTATTCATAAATGGATTGCCACTAGTACCTAT
ACCTAAGGGTTGTCCACGTCCAACCTCCACACCAGAACAGGCCCATACTAGG
CGCTCCTTATCAGGATTATAAAAGGATGCATCTGGAAATCCAAATTTATTAGG
ATCTGGTAAACGAAGCCTAAACACCCTGTATTGCAAACCTGAAACTTTAGGA
ACTATGGTTTTACGTTTTGAGAATCCTTGATAGGAAAATATGGGTGTCCCAC
AGCCAACAAACGTGTGCTACCTGCATAATAATATATTTGTTCTTGTTACAT
ATTCATCTGTGCTTACAACCTTAGACACAGACACAGGGGGCAGGTATACCTTT
GCATCAGTAGGTCGCCACATCTCGAGGGGGGGCCCGGTACCCAGCTTTTGTT
```

FIG. 18D

CCCTTTAGTGAGGGTTAATTGCGCGCTTGGCGTAATCATGGTCATAGCTGTTT
CCTGTGTGAAATTGTTATCCGCTCACAATTCCACACAACATACGAGCCGGGA
GCATAAAGTGTAAAGCCTGGGGTGCCTAATGAGTGAGCTAACTCACATTAAT
TGCGTTGCGCTCACTGCCCGCTTTCCAGTCGGGAAACCTGTCGTGCCAGCTGC
ATTAATGAATCGGCCAACGCGCGGGGAGAGGCGGTTTGCGTATTGGGCGCTC
TTCCGCTTCCTCGCTCACTGACTCGCTGCGCTCGGTCGTTCGGCTGCGGCGAG
CGGTATCAGCTCACTCAAAGGCGGTAATACGGTTATCCACAGAATCAGGGGA
TAACGCAGGAAAGAACATGTGAGCAAAAGGCCAGGAACCGTAAAAAGGCCG
CGTTGCTGGCGTTTTTCCATAGGCTCCGCCCCCTGACGAGCATCACAAAAAT
CGACGCTCAAGTCAGAGGTGGCGAAACCCGACAGGACTATAAAGATACCAG
GCGTTTCCCCCTGGAAGCTCCCTCGTGCGCTCTCCTGTTCCGACCCTGCCGCT
TACCGGATACCTGTCCGCCTTTCTCCCTTCGGGAAGCGTGGCGCTTTCTCATA
GCTCACGCTGTAGGTATCTCAGTTCGGTGTAGGTCGTTCGCTCCAAGCTGGGC
TGTGTGCACGAACCCCCGTTCAGCCCGACCGCTGCGCCTTATCCGGTAACTA
TCGTCTTGAGTCCAACCCGGTAAGACACGACTTATCGCCACTGGCAGCAGCC
ACTGGTAACAGGATTAGCAGAGCGAGGTATGTAGGCGGTGCTACAGAGTTCT
TGAAGTGGTGGCCTAACTACGGCTACACTAGAAGAACAGTATTTGGTATCTG
CGCTCTGCTGAAGCCAGTTACCTTCGGAAAAAGAGTTGGTAGCTCTTGATCCG
GCAAACAAACCACCGCTGGTAGCGGTGGTTTTTTGTTTGCAAGCAGCAGATT
ACGCGCAGAAAAAAGGATCTCAAGAAGATCCTTTGATCTTTTCTACGGGGT
CTGACGCTCAGTGGAACGAAAACTCACGTTAAGGGATTTTGGTCATGAGATT
ATCAAAAAGGATCTTCACCTAGATCCTTTTAAATTAAAAATGAAGTTTTAAAT
CAATCTAAAGTATATATGAGTAAACTTGGTCTGACAGTTACCAATGCTTAATC
AGTGAGGCACCTATCTCAGCGATCTGTCTATTTCGTTCATCCATAGTTGCCTG
ACTCCCCGTCGTGTAGATAACTACGATACGGGAGGGCTTACCATCTGGCCCC
AGTGCTGCAATGATACCGCGAGACCCACGCTCACCGGCTCCAGATTTATCAG
CAATAAACCAGCCAGCCGGAAGGGCCGAGCGCAGAAGTGGTCCTGCAACTTT
ATCCGCCTCCATCCAGTCTATTAATTGTTGCCGGGAAGCTAGAGTAAGTAGTT
CGCCAGTTAATAGTTTGCGCAACGTTGTTGCCATTGCTACAGGCATCGTGGTG
TCACGCTCGTCGTTTGGTATGGCTTCATTCAGCTCCGGTTCCCAACGATCAAG
GCGAGTTACATGATCCCCCATGTTGTGCAAAAAAGCGGTTAGCTCCTTCGGTC
CTCCGATCGTTGTCAGAAGTAAGTTGGCCGCAGTGTTATCACTCATGGTTATG
GCAGCACTGCATAATTCTCTTACTGTCATGCCATCCGTAAGATGCTTTTCTGT
GACTGGTGAGTACTCAACCAAGTCATTCTGAGAATAGTGTATGCGGCGACCG
AGTTGCTCTTGCCCGGCGTCAATACGGGATAATACCGCGCCACATAGCAGAA
CTTTAAAAGTGCTCATCATTGGAAAACGTTCTTCGGGGCGAAAACTCTCAAG
GATCTTACCGCTGTTGAGATCCAGTTCGATGTAACCCACTCGTGCACCCAACT
GATCTTCAGCATCTTTTACTTTCACCAGCGTTTCTGGGTGAGCAAAAACAGGA
AGGCAAAATGCCGCAAAAAAGGGAATAAGGGCGACACGGAAATGTTGAATA
CTCATACTCTTCCTTTTTCAATATTATTGAAGCATTTATCAGGGTTATTGTCTC
ATGAGCGGATACATATTTGAATGTATTTAGAAAAATAAACAAATAGGGGTTC
CGCGCACATTTCCCCGAAAAGTGCCACCTAAATTGTAAGCGTTAATATTTTGT
TAAAATTCGCGTTAAATTTTGTTAAATCAGCTCATTTTTTAACCAATAGGCC
GAAATCGGCAAAATCCCTTATAAATCAAAAGAATAGACCGAGATAGGGTTGA
GTGTTGTTCCAGTTTGGAACAAGAGTCCACTATTAAAGAACGTGGACTCCAA
CGTCAAAGGGCGAAAAACCGTCTATCAGGGCGATGGCCCACTACGTGAACCA

FIG. 18E

TCACCCTAATCAAGTTTTTTGGGGTCGAGGTGCCCGTAAAGCACTAAATCGG
AACCCTAAAGGGAGCCCCCGATTTAGAGCTTGACGGGGAAAGCCGGCGAAC
GTGGCGAGAAAGGAAGGGAAGAAAGCGAAAGGAGCGGGCGCTAGGGCGCT
GGCAAGTGTAGCGGTCACGCTGCGCGTAACCACCACACCCGCCGCGCTTAAT
GCGCCGCTACAGGGCGCGTCCCATTCGCCATTCAGGCTGCGCAACTGTTGGG
AAGGGCGATCGGTGCGGGCCTCTTCGCTATTACGCCAGCTGGCGAAAGGGGG
ATGTGCTGCAAGGCGATTAAGTTGGGTAACGCCAGGGTTTTCCCAGTCACGA
CGTTGTAAAACGACGGCCAGTGAGCGCGCGTAATACGA*CTCACTATAGGGC*
*GAATT*GGAGCTCCACCGCGGTGGCGGCCGCCTGTAAAGAATATGACAGAC
GTTTACGTTTGCGCTTTAACAAATAATAACTAGGGTGTAATATAAAACCTGAC
CCATAAATATATATAGGACCAGCAGGCTGTAATGGCACTATTGGTGTAAAAA
TAGTTTCTGTAGAAGGTAGTGGTAAAGCAATATCTGGACCAGGATGTGTGTC
TAACCCAGTACTAAAAGGAATAGTTGTATTTGCAGTTGCAGTAGAAATATCA
CTACTAACTAAACTATTACTATGTATACTTGTAGGTGTATATGTTTGTTGTAGT
ACAGTCTCTTCTACATCATTGTCTAAAAACACATCATATAACCCATCATTAAT
ACTACTACCAGTTACTATACTAGGTGTTTGTGGTGTAACTAAAGGTTGCATTT
CAATATCATTAGTAGGTATAGGACTTATATCATGATAAAATGTACTTTAGCA
CCTATACGTTTGCCACTTCTAGTAGAAAGTGTTGCACGTTGTCCCAATCTACT
AACACGTATGCCTGTTTATGTTGTAACAGATATTTGTGTAGTATCACTAATA
GCAGATACATCTATAATAGCAGGTGTACTGTTTACAGAAGTTGTAATATCAA
ACCCTGAAGTAGAAGGCACTATAGATGTAGGACCAGGTATACCTGACTCTAT
AAAACTTGATTCTTCCACTAATGAAACAATAGAAGAATCTGAAGGCCCAACA
GACGTAACAACTGATGGTCGTATAGGTTGTAATGGAATTTCAACTGGTTTAG
ATGGTGTGCCTGTAGATAATGGAACGTATCCAGTACGCCCCCTGATCCAGA
CCCACTACCTATTCCCAATCCCCCAAAAAAAACTCCAATACTACCATATTTTA
ATATATTATCAGCTATAGTACTACCTTCAACCTTGGGAATTACATCAGGAGGG
CACGTACCTGCTTGTTTACATGTTTTATATAATTGTGTTGCAGATGCACGTTTT
TTTCGTATGTGTGTGTCACGCTTGCGACGCATGGTACACTAAAAATATTAGGC
AGTTTATTATATGTAAAATTGTTTATGTTATTTGTAATGTAGCATGGTAAT
GTACAAGTGCCATAGGAATATAAAATACCAAAACATATAAAAAAAATACTTT
TAACAATGATTGTGATACATGTATAAAGGTTATTATAATCAATACCAATAACC
ATGGGTAAATATACACAGACACTGCAAGCGACACACACAAGCACAAACAAA
AGCCAACACAAAACAAAAATACAAATATACAAAGAATCATATATACTGTGTA
ACCAATGTTACAAAGACATGTATCCTGATGTAACTACAATAGTTTGTGGTATT
TTTACATGTTGTAAAAAATGTTGTTGTTGCAATACAGTTGTAAACATTAATGT
TATTACACCACATTTACTATTTGTAGTATTGGTCCAATGCCATGTTGTTGTTAC
ATTTTTAAATAAATGTGAATAGCCTTTATGCAATCTATATCTAAAACATTTTA
AGCTGTTTTTGTCACCTTTTAAATGCACTATTGGCGCAACATTATGTGTAGTA
CACTGGGTACAGGACTCTGTGGTGGGATGTAGGTTATGCAAACAATCCAGGG
GCCTCTGGTCCGAGTCACACTGTCTTTGCCGTTCCGTGATGGCACACCGGTG
TCAACGTTGGTGCAGGTGGTGGTGGTGTTGGTGGTTGTGGTGTGCAGTGGGTT
AACAATTTCAGGAATGGATACTTCACAGGCGCTAGATACAGGAGCACAACAT
ATTACCTGACCACCCATATGTACTTCCCATATGCCTTTTACCCCGTACCGTTTT
GCATCTGTATCAAATCTTGTATAGTATACCTTTTCCTCATCATCTGTTTCATAA
TATATACCATTATAATCTATTTTGCTACCTACCTTTGCCCACCCCCTTCATAC
CAACAATATATATGTGTCCAAAATACATATTGCATGCTATTGTCCTTTTCACA

FIG. 18F

```
GTCATATCTAACCTCTACTGTGCTAGCAATGCTGCTTTTGCATTATTCCTTTGT
AATAAATTTGTAATATCTGTTATAGGTGTGCTCTCTGTTTCTATATCCATATTT
GAAATGCTACTGGACCCACTACTGCTTTCACGTGGCGACACAATTTGGTTGCC
TTCTTCATTAACATTTTGTAAACACCCTACCCCTGCCCCAAGTCCCGGTACCT
CTGTCTCGTAAGTTTCCACTTCAGTATTGCCATATCCACTGTCCTGCTCCTCAA
ACAGTCTTCGTTTAGATGTACTTCTACCGCTACTTATTGACAATACATTTATTT
GTGGACTAAGCTGTTTGTCTATGAATTCATCTCTTTTCATATCTGGGCTACCGC
CAGGACTACCTGTAAACTTTCGTTTTAGAACACGTATAGCCTCATTGTCTGCA
TTTGCTTGCTGTGACTGATACAATGCCTGTGCAATTTCCTGTTGTGCATATATA
TTTGGTATATGTGCATTATCAATAAAATCCCCCATTTCCGACTCATCTGTATCC
CCTCCATCATAATTTTCATCCTCTGGAATTG
```

FIG. 21
HPV 26XX Restriction Map Verification
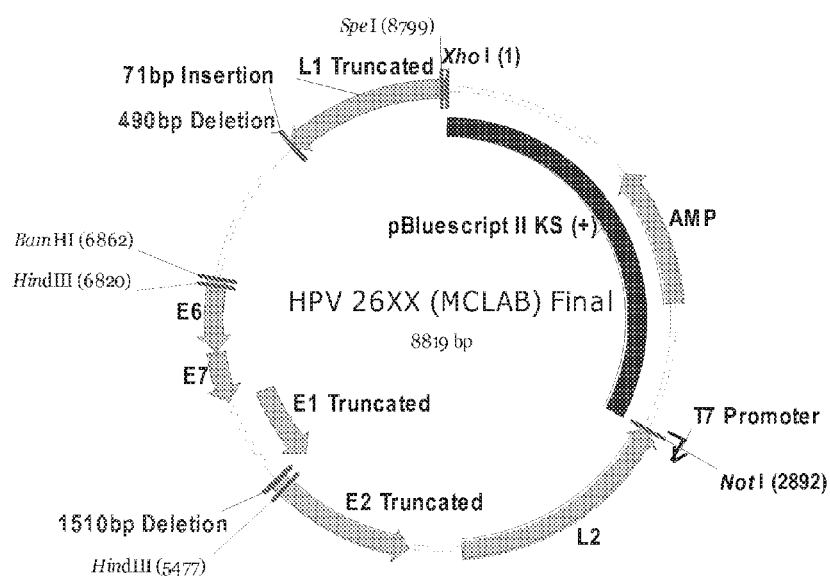
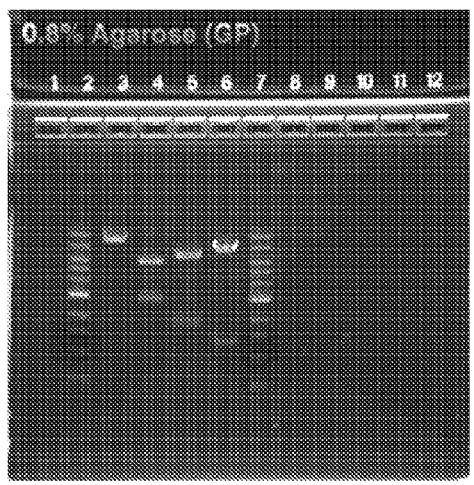
| HPV 26xx ||| 
|---|---|---|
| Lane | Digestion | Fragment Size (bp) |
| 1 | Blank | - |
| 2 | 1 kb DNA Ladder | - |
| 3 | XhoI | 8,819 |
| 4 | XhoI/NotI | 5,927+ 2,892 |
| 5 | BamHI/SpeI | 6,882 + 1,937 |
| 6 | HindIII | 7,476 + 1,343 |
| 7 | 1 kb DNA Ladder | - |
| 8 | Blank | - |

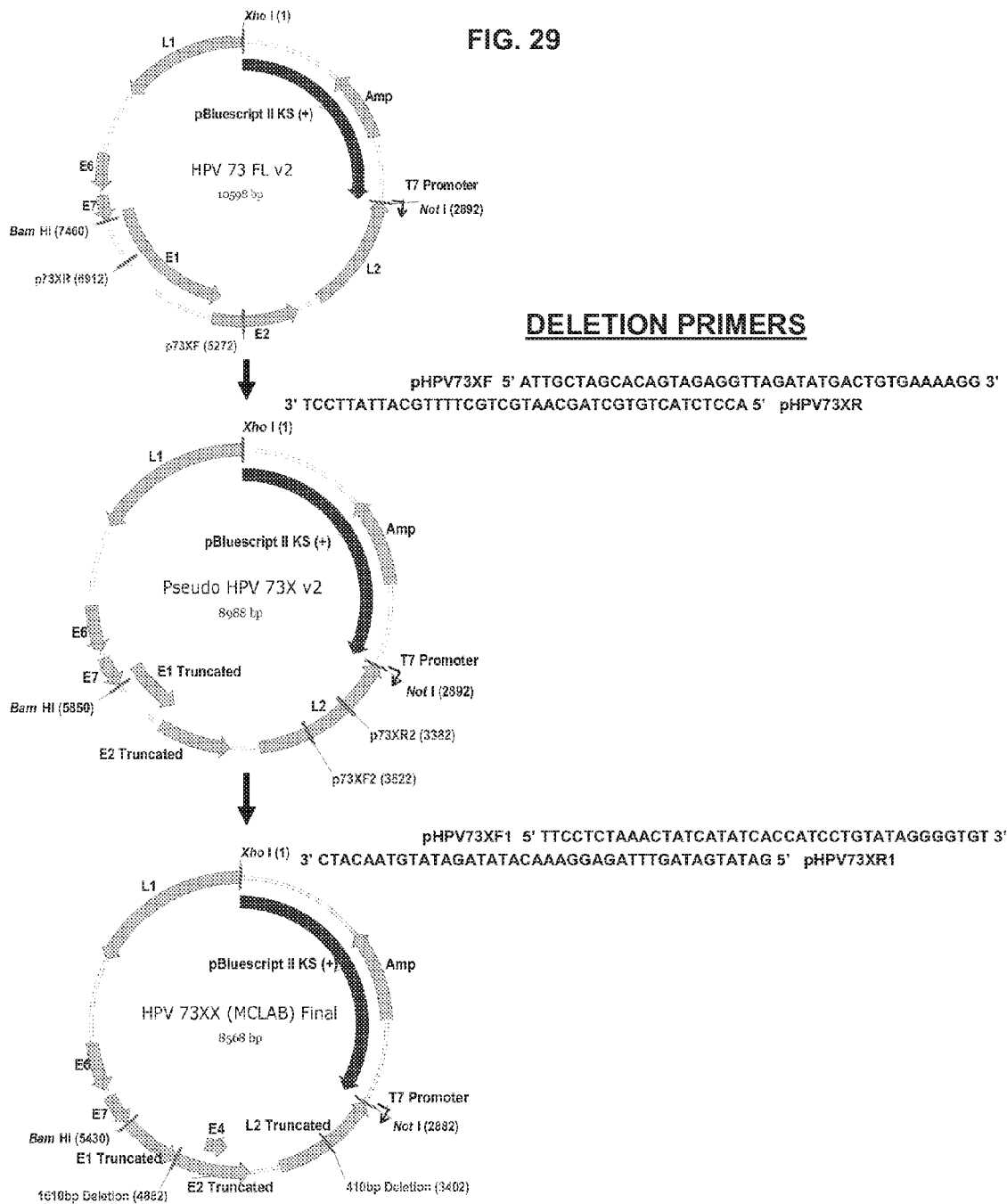

FIG. 30

| | | HIGH RISK | | | | | | | | | | | | | | | | |
|---|---|---|---|---|---|---|---|---|---|---|---|---|---|---|---|---|---|---|
| | GenBank Accesion Number | K02718 | AY262282 | X74472 | J04353 | M12732 | M74114 | M62849 | X74479 | M62877 | X74481 | X74483 | D90400 | X77858 | U31794 | DQ080079 | X94165 | AB027021 |
| GenBank Accesion Number | HPV Type | gb HPV 16 | gb HPV 18 | gb HPV 26 | gb HPV 31 | gb HPV 33 | gb HPV 35 | gb HPV 39 | gb HPV 45 | gb HPV 51 | gb HPV 52 | gb HPV 56 | gb HPV 58 | gb HPV 59 | gb HPV 66 | gb HPV 68 | gb HPV 73 | gb HPV 82 |
| NC_001356 | gb HPV 1 | 49 | 48 | 48 | 49 | 52 | 49 | 48 | 48 | 48 | 48 | 47 | 52 | 49 | 48 | 49 | 49 | 48 |
| NC_001352 | gb HPV 2 | 54 | 56 | 55 | 55 | 55 | 55 | 56 | 56 | 55 | 54 | 54 | 55 | 56 | 54 | 56 | 54 | 55 |
| X74462 | gb HPV 3 | 56 | 57 | 56 | 56 | 56 | 55 | 57 | 56 | 57 | 56 | 54 | 57 | 57 | 56 | 57 | 55 | 56 |
| NC_001457 | gb HPV 4 | 50 | 50 | 49 | 49 | 51 | 49 | 50 | 49 | 50 | 49 | 47 | 52 | 50 | 49 | 50 | 50 | 50 |
| NC_001531 | gb HPV 5 | 48 | 49 | 49 | 49 | 50 | 48 | 48 | 49 | 48 | 48 | 45 | 49 | 49 | 47 | 49 | 49 | 48 |
| AF092932 | gb HPV 6 | 56 | 56 | 54 | 57 | 63 | 56 | 54 | 55 | 54 | 54 | 56 | 62 | 55 | 54 | 55 | 57 | 54 |
| PPH8CG | gb HPV 8 | 49 | 48 | 48 | 49 | 48 | 49 | 49 | 49 | 48 | 48 | 44 | 48 | 49 | 48 | 50 | 48 | 49 |
| M14119 | gb HPV 11 | 60 | 59 | 58 | 60 | 53 | 60 | 59 | 59 | 58 | 60 | 53 | 54 | 58 | 58 | 59 | 60 | 58 |
| X62843 | gb HPV 13 | 58 | 58 | 57 | 58 | 60 | 59 | 57 | 57 | 56 | 58 | 56 | 60 | 57 | 56 | 57 | 58 | 56 |
| X74474 | gb HPV 30 | 60 | 62 | 65 | 60 | 62 | 60 | 61 | 62 | 65 | 60 | 71 | 61 | 62 | 76 | 61 | 60 | 65 |
| NC_001587 | gb HPV 34 | 62 | 59 | 60 | 61 | 63 | 61 | 59 | 59 | 59 | 61 | 66 | 64 | 58 | 60 | 62 | 76 | 60 |
| X74478 | gb HPV 40 | 57 | 57 | 56 | 57 | 58 | 57 | 56 | 56 | 55 | 56 | 54 | 58 | 56 | 56 | 56 | 57 | 55 |
| M73236 | gb HPV 42 | 59 | 59 | 58 | 60 | 62 | 60 | 58 | 59 | 58 | 59 | 56 | 62 | 58 | 58 | 58 | 59 | 57 |
| AJ620205 | gb HPV 43 | 58 | 57 | 56 | 58 | 59 | 58 | 56 | 56 | 56 | 57 | 55 | 58 | 57 | 56 | 56 | 58 | 56 |
| U31788 | gb HPV 44 | 58 | 57 | 56 | 58 | 59 | 58 | 57 | 57 | 56 | 58 | 56 | 58 | 56 | 57 | 57 | 57 | 56 |
| NC_001593 | gb HPV 53 | 59 | 62 | 65 | 60 | 62 | 59 | 61 | 63 | 65 | 59 | 71 | 61 | 62 | 77 | 62 | 60 | 65 |
| HPU37488 | gb HPV 54 | 57 | 56 | 57 | 57 | 62 | 57 | 55 | 55 | 56 | 57 | 60 | 62 | 56 | 56 | 56 | 58 | 56 |
| HPU31791 | gb HPV 55 | 58 | 58 | 54 | 58 | 57 | 57 | 56 | 57 | 57 | 56 | 57 | 56 | 56 | 57 | 56 | 58 | 56 |
| HPU31793 | gb HPV 61 | 55 | 58 | 57 | 56 | 56 | 56 | 57 | 57 | 56 | 56 | 55 | 56 | 57 | 56 | 58 | 56 | 56 |
| AY395706 | gb HPV 62 | 54 | 57 | 56 | 55 | 57 | 54 | 57 | 57 | 55 | 55 | 55 | 56 | 57 | 55 | 57 | 56 | 56 |
| In-house sequence | HPV 64 | 62 | 59 | 60 | 61 | 63 | 61 | 59 | 59 | 59 | 61 | 66 | 64 | 58 | 60 | 62 | 76 | 60 |
| D21208 | gb HPV 67 | 67 | 59 | 60 | 66 | 76 | 68 | 59 | 59 | 60 | 76 | 59 | 76 | 60 | 60 | 59 | 62 | 60 |
| AB027020 | gb HPV 69 | 62 | 63 | 84 | 61 | 63 | 61 | 63 | 63 | 73 | 61 | 62 | 62 | 63 | 65 | 63 | 62 | 71 |
| HPU21941 | gb HPV 70 | 59 | 67 | 61 | 60 | 60 | 59 | 78 | 66 | 61 | 59 | 64 | 61 | 66 | 61 | 78 | 60 | 60 |
| AB040456 | gb HPV 71 | 57 | 58 | 58 | 57 | 59 | 56 | 57 | 58 | 58 | 56 | 56 | 59 | 57 | 57 | 58 | 56 | 58 |
| X94164 | gb HPV 72 | 55 | 57 | 57 | 56 | 56 | 56 | 57 | 57 | 56 | 56 | 55 | 56 | 57 | 56 | 58 | 56 | 56 |
| AF436130 | gb HPV 74 | 59 | 60 | 59 | 60 | 58 | 59 | 59 | 60 | 59 | 59 | 59 | 58 | 59 | 59 | 59 | 59 | 59 |
| AJ620299 | gb HPV 81 | 56 | 58 | 56 | 56 | 57 | 56 | 57 | 57 | 57 | 56 | 56 | 57 | 57 | 56 | 57 | 56 | 57 |
| AF151983 | gb HPV 83 | 57 | 59 | 58 | 57 | 50 | 57 | 58 | 58 | 58 | 57 | 51 | 50 | 58 | 58 | 59 | 56 | 57 |
| AF293960 | gb HPV 84 | 55 | 57 | 57 | 55 | 57 | 56 | 56 | 57 | 56 | 55 | 55 | 57 | 57 | 56 | 57 | 55 | 56 |
| AF131950 | gb HPV 85 | 62 | 72 | 63 | 62 | 64 | 61 | 73 | 73 | 63 | 61 | 61 | 64 | 71 | 64 | 73 | 61 | 63 |
| AF436128 | gb HPV 89 | 55 | 56 | 56 | 55 | 56 | 55 | 57 | 57 | 56 | 55 | 54 | 56 | 56 | 56 | 57 | 55 | 56 |

LOW RISK (row axis) / % IDENTITY (column axis)

FAST RESULTS HYBRID CAPTURE ASSAY AND ASSOCIATED STRATEGICALLY TRUNCATED PROBES

REFERENCE TO RELATED APPLICATIONS

This application claims priority to U.S. Provisional Patent Application No. 61/347,941, filed on May 25, 2010, the entire contents of which are hereby incorporated by reference.

BACKGROUND OF THE INVENTION

1. Field of the Invention

The present invention relates to methods, reagents, high throughput systems, and kits for determining the presence of a nucleic acid in a sample.

2. Background of the Invention

The detection and characterization of specific nucleic acid sequences and sequence changes have been utilized to detect the presence of viral or bacterial nucleic acid sequences indicative of an infection, the presence of variants or alleles of mammalian genes associated with disease and cancers, and the identification of the source of nucleic acids found in forensic samples, as well as in paternity determinations.

For example, the RNA or DNA for many microorganisms and viruses have been isolated and sequenced. Nucleic acid probes have been examined for a large number of infections. Detectable nucleic acid sequences that hybridize to complementary RNA or DNA sequences in a test sample have been previously utilized. Detection of the probe indicates the presence of a particular nucleic acid sequence in the test sample for which the probe is specific. In addition to aiding scientific research, DNA or RNA probes can be used to detect the presence of viruses and microorganisms such as bacteria, yeast and protozoa as well as genetic mutations linked to specific disorders in patient samples.

Nucleic acid hybridization probes have the advantages of high sensitivity and specificity over other detection methods and do not require a viable organism. Hybridization probes can be labeled, for example with a radioactive substance that can be easily detected, or with biochemical markers such as, for example, biotin, that allows for their capture and detection. Highly sensitive strategically-truncated probes may also be constructed by eliminating sequence regions exhibiting cross-reactive with undesirable or unwanted regions. Nucleic acid molecules may also by captured by a first antibody that is specific to DNA hybrids, wherein the hybrids may comprise DNA-RNA hybrids, DNA-DNA hybrids or RNA-RNA hybrids. The hybrids may subsequently be detected by a second, labeled, antibody that may be, for example, labeled with a biochemical marker such as alkaline phosphatase or any other marker capable of detection.

As nucleic acid sequence data for genes from humans and pathogenic organisms accumulates, the demand for fast, cost-effective, and easy-to-use tests increases. There is a need to provide novel and effective methods, compositions, and kits for determining a target nucleic acid in a sample faster and more. The methods and assays of the present invention meet these needs and may be used in high throughput automated systems. In another aspect, the methods and assays may be implemented in partially automated systems.

BRIEF SUMMARY OF THE INVENTION

In one aspect, the present disclosure relates to polynucleotide probes at least 1 kilobase in length wherein the polynucleotide probe is capable of hybridizing to a high risk HPV nucleic acid, but does not cross-react with a low risk HPV nucleic acid. In one aspect, the polynucleotide probe comprises at least one sequence having from 70% to 100% complementarity to at least 100 contiguous bases of each of L1, L2, E1, E2, E4, E6, and E7 of a high risk HPV nucleic acid, wherein said polynucleotide probe. In a further aspect, the polynucleotide probe does not contain any sequences of at least 100 contiguous bases which have about 70% to 100% complementarity to at least 100 contiguous bases of a low risk HPV nucleic acid. In another aspect, the polynucleotide probe does not comprise any sequences having about 70% to 100% identity to SEQ ID NO: 44 to SEQ ID NO: 57, SEQ ID NO: 111 to SEQ ID NO: 115, or a complement thereof. In yet a further aspect, the polynucleotide probe is specific for a high risk HPV nucleic acid selected from the group consisting of SEQ ID NO: 1 to SEQ ID NO: 17 and SEQ ID NO: 104 to SEQ ID NO: 110, SEQ ID NO: 116, or a complement thereof. In another aspect, the polynucleotide probe comprises a sequence having about 70% to 100% identity to a sequence selected from the group consisting of SEQ ID NO: 97 to SEQ ID NO: 103 or a complement thereof. In yet another aspect, the polynucleotide probe consists essentially of or consists of a sequence selected from the group consisting of SEQ ID NO: 97 to SEQ ID NO: 103 or a complement thereof.

In an aspect, the present disclosure provides for a nucleic acid comprising a sequence at least 1 kilobase in length sharing 70% or more; 75% or more, 80% or more, 85% or more, 90% or more, 95% or more, 98% or more, or 100% identity to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 116, SEQ ID NO: 117 or a complement thereof, with the proviso that said nucleic acid does not comprise any sequences sharing 70% or more; 75% or more, 80% or more, 85% or more, 90% or more, 95% or more, 98% or more, or 100% identity with SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, or a complement thereof.

The present disclosure also provides for a probe set of one or more probes comprising, consisting essentially of, or consisting of a nucleic acid sharing 70% or more; 75% or more, 80% or more, 85% or more, 90% or more, 95% or more, 98% or more, or 100% identity to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 116; SEQ ID NO: 117, or a complement thereof, with the proviso that said nucleic acid does not comprise any sequences sharing 70% or more; 75% or more, 80% or more, 85% or more, 90% or more, 95% or more, 98% or more, or 100% identity with SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, or a complement thereof.

In an aspect, the disclosure provides for a method for determining the presence of a target nucleic acid molecule in a sample including:
 a) suspending the sample in a collection medium;
 b) releasing target nucleic acid molecules from the sample into the collection medium;
 c) converting double-stranded target nucleic acid molecules to single-stranded target nucleic acid molecules;
 d) contacting one or more polynucleotide probes with the single-stranded target nucleic acid molecules under conditions that allow the polynucleotide probes and target single-stranded target nucleic acid molecules to hybridize forming double-stranded nucleic acid hybrids;
 e) capturing the double-stranded nucleic acid hybrids;
 f) separating the double-stranded nucleic acid hybrids from un-bound single-stranded target nucleic acid molecules; and
 g) detecting the double-stranded nucleic acid hybrids, thereby indicating the presence of the target nucleic acid.

In an aspect, the polynucleotide probe is a strategically-truncated probe specific for a high risk HPV nucleic acid, wherein the deleted portion shares high sequence identity or cross reactivity to a HPV low risk type. In an aspect, the HPV high risk strategically-truncated probe is specific for or capable of hybridizing to one or more HPV types 16, 18, 26, 31, 33, 35, 39, 45, 51, 52, 56, 58, 59, 66, 68, 73, and 82 and the deleted portion exhibits cross reactivity or specificity with one or more of low risk HPV types 1, 2, 3, 4, 5, 6, 8, 11, 13, 30, 34, 40, 42, 43, 44, 53, 61, 67, 69, 70, 71, 72, 74, 81, 83, 84, and 89. In another aspect, the deleted portion of the probe comprises a sequence sharing 75% or more, 80% or more, 85% or more, 90% or more, 95% or more, 98% or more, or 100% identity to SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57. In another aspect, the polynucleotide probes are nucleic acid sequences sharing 75% or more, 80% or more, 85% or more, 90% or more, 95% or more, 98% or more, or 100% identity to SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 97, SEQ ID NO: 98, SEQ ID NO: 99, SEQ ID NO: 100, SEQ ID NO: 101, SEQ ID NO: 102, SEQ ID NO: 103, OR SEQ ID NO: 117, SEQ ID NO: 111, SEQ ID NO: 112, SEQ ID NO: 113, SEQ ID NO: 114, SEQ ID NO: 115, or a complement thereof.

Another aspect relates to the rapid detection of target nucleic acid molecules in a sample using the probes disclosed herein. The detection method may be automated, either fully automated, or partially automated—in other words requiring some human input.

Another aspect relates to the detection of target nucleic acid molecules in multiple samples at the same time or within a very short period of time, for example in a machine or a series of machines, using the probes disclosed herein.

Another aspect relates to a kit for the detection of a target nucleic acid molecule in a sample comprising the probes disclosed herein.

BRIEF DESCRIPTION OF THE DRAWINGS

FIG. 1A-D exhibits the sequence for an exemplary template which can be used to generate strategically-truncated probes specific for HPV33. Underlined text indicates binding sites for the deletion primers. Hatched underlining indicates overlapping sites for the deletion primers. Lower-case text indicates sequences selected for truncation. Template sequences can be found at SEQ ID NO: 5 (including vector sequences) and SEQ ID NO: 104 (HPV sequences only).

FIG. 2A-C exhibits the sequence for an exemplary template which can be used to generate strategically-truncated probes specific for HPV39. Underlined text indicates binding sites for the deletion primers. Hatched underlining indicates overlapping sites for the deletion primers. Lower-case text indicates sequences selected for truncation. Template sequences can be found at SEQ ID NO: 7 (including vector sequences) and SEQ ID NO: 105 (HPV sequences only).

FIG. 3A-D exhibits the sequence for an exemplary template which can be used to generate strategically-truncated probes specific for HPV52. Underlined text indicates binding sites for the deletion primers. Hatched underlining indicates overlapping sites for the deletion primers. Lower-case text indicates sequences selected for truncation. Template sequences can be found at SEQ ID NO: 10 (including vector sequences) and SEQ ID NO: 106 (HPV sequences only).

FIG. 4A-C exhibits the sequence for an exemplary template which can be used to generate strategically-truncated probes specific for HPV56. Underlined text indicates binding sites for the deletion primers. Hatched underlining indicates overlapping sites for the deletion primers. Lower-case text indicates sequences selected for truncation. Template sequences can be found at SEQ ID NO: 11 (including vector sequences) and SEQ ID NO: 107 (HPV sequences only).

FIG. 5A-D exhibits the sequence for an exemplary template which can be used to generate strategically-truncated probes specific for HPV58. Underlined text indicates binding sites for the deletion primers. Hatched underlining indicates overlapping sites for the deletion primers. Lower-case text indicates sequences selected for truncation. Template sequences can be found at SEQ ID NO: 12 (including vector sequences) and SEQ ID NO: 108 (HPV sequences only).

FIG. 6A-C exhibits the sequence for an exemplary template which can be used to generate strategically-truncated probes specific for HPV66. Underlined text indicates binding sites for the deletion primers. Hatched underlining indicates overlapping sites for the deletion primers. Lower-case text indicates sequences selected for truncation. Template sequences can be found at SEQ ID NO: 14 (including vector sequences) and SEQ ID NO: 109 (HPV sequences only).

FIG. 7A-C exhibits the sequence for an exemplary template which can be used to generate strategically-truncated probes specific for HPV68. Underlined text indicates binding sites for the deletion primers. Hatched underlining indicates overlapping sites for the deletion primers. Lower-case text indicates sequences selected for truncation. Template sequences can be found at SEQ ID NO: 15 (including vector sequences) and SEQ ID NO: 110 (HPV sequences only).

FIG. 8A-C exhibits the sequence for an exemplary template which can be used to generate strategically-truncated probes specific for HPV26 (SEQ ID NO: 116). Underlined text indicates binding sites for the deletion primers. Hatched underlining indicates overlapping sites for the deletion primers. Lower-case text indicates sequences selected for truncation.

FIG. 9A-E exhibits the sequence for an exemplary template which can be used to generate strategically-truncated probes specific for HPV73. Underlined text indicates binding sites for the deletion primers. Hatched underlining indicates overlapping sites for the deletion primers. Lower-case text indicates sequences selected for truncation.

FIG. 10A-E exhibits a restriction map of the HPV26XX strategically-truncated probe and its sequence (SEQ ID NO: 117). Deletion primer binding sites are indicated by single underlining, with primer overlap indicated by hatched underlining. The promoter site is indicated by bolded, italicized, and double underlined text. Shaded text indicates probe sequences.

FIG. 11A-F exhibits a restriction map of the HPV33X strategically-truncated probe and its sequence. Deletion primer binding sites are indicated by single underlining, with primer overlap indicated by hatched underlining. The promoter site is indicated by bolded, italicized, and double underlined text. Shaded text indicates probe sequences.

FIG. 12A-F exhibits a restriction map of the HPV39XX strategically-truncated probe and its sequence. Deletion primer binding sites are indicated by single underlining, with primer overlap indicated by hatched underlining. The promoter site is indicated by bolded, italicized, and double underlined text. Shaded text indicates probe sequences.

FIG. 13A-F exhibits a restriction map of the HPV52X strategically-truncated probe and its sequence. Deletion primer binding sites are indicated by single underlining, with primer overlap indicated by hatched underlining. The promoter site is indicated by bolded, italicized, and double underlined text. Shaded text indicates probe sequences.

FIG. 14A-F exhibits a restriction map of the HPV56XX strategically-truncated probe and its sequence. Deletion primer binding sites are indicated by single underlining, with primer overlap indicated by hatched underlining. The promoter site is indicated by bolded, italicized, and double underlined text. Shaded text indicates probe sequences.

FIG. 15A-E exhibits a restriction map of the HPV58X strategically-truncated probe and its sequence. Deletion primer binding sites are indicated by single underlining, with primer overlap indicated by hatched underlining. The promoter site is indicated by bolded, italicized, and double underlined text. Shaded text indicates probe sequences.

FIG. 16A-F exhibits a restriction map of the HPV66XX strategically-truncated probe and its sequence. Deletion primer binding sites are indicated by single underlining, with primer overlap indicated by hatched underlining. Note that "***" indicates the site at which the primers pHPV66XF1 (SEQ ID NO: 76) and pHPV66XR1 (SEQ ID NO: 77) would bind in the template. The promoter site is indicated by bolded, italicized, and double underlined text. Shaded text indicates probe sequences.

FIG. 17A-F exhibits a restriction map of the HPV68XX strategically-truncated probe and its sequence. Deletion primer binding sites are indicated by single underlining, with primer overlap indicated by hatched underlining. The promoter site is indicated by bolded, italicized, and double underlined text. Shaded text indicates probe sequences.

FIG. 18A-F exhibits a restriction map of the HPV73XX strategically-truncated probe and its sequence. Deletion primer binding sites are indicated by single underlining, with primer overlap indicated by hatched underlining. The promoter site is indicated by bolded, italicized, and double underlined text. Shaded text indicates probe sequences.

FIG. 21 exhibits a restriction map and a sample digestion of HPV26XX strategically-truncated plasmid.

FIG. 29 demonstrates a sample schematic for generating the HPV 73XX strategically-truncated plasmid.

FIG. 30 demonstrates the results of a sequence alignment between high risk and low risk HPV-types using Vector NTI 10.3.0 software (Invitrogen Corp., Carlsbad, Calif.). Shaded cells indicate sequences having a high risk of cross-reactivity. Sequences having from about 70% to 100% sequence identity are deemed to have a high risk of cross-reactivity. Sequences having from about 75% to 100% sequence identity are deemed to have a moderately high risk of cross-reactivity. Sequences having from about 80% to 100% sequence identity are deemed to have very high risk of cross-reactivity.

DETAILED DESCRIPTION OF THE INVENTION

Figure 19:
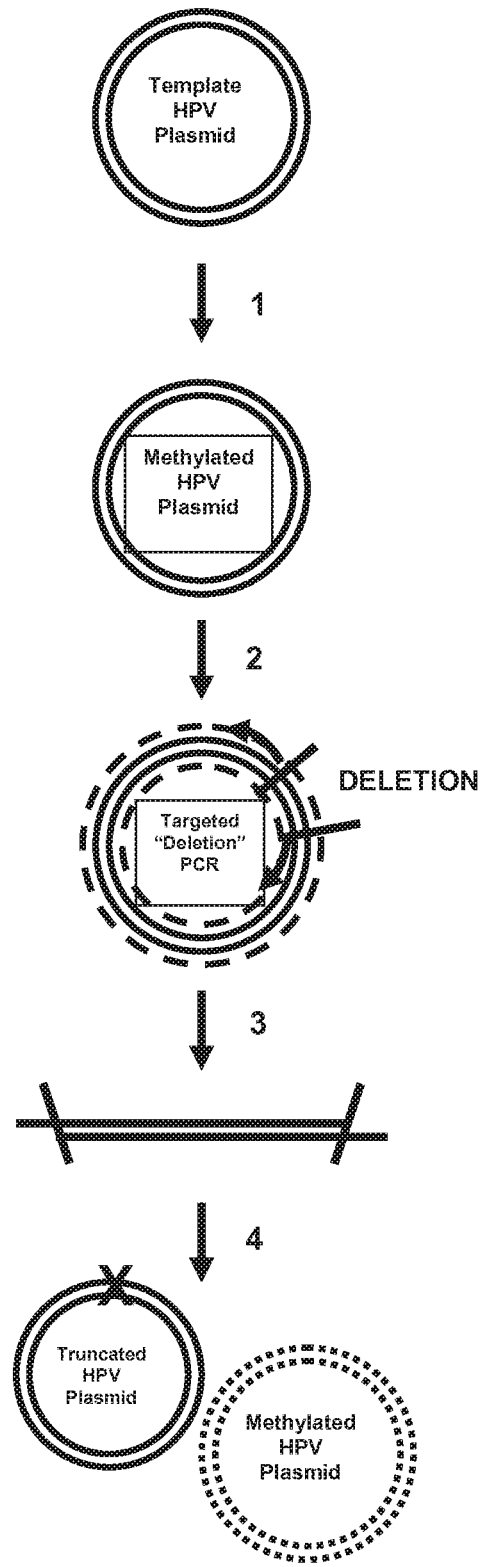
FIG. 19 exhibits a sample schematic for generating truncated HR-HPV probes. As show in FIG. 19, a plasmid comprising the deletion probe is generated according to the following steps: 1. The target HPV template plasmid is methylated. 2. Plasmids are amplified, minus the targeted deletion, using two primers with overlapping tails (deletion primers). 3. The resulting PCR products are linear double stranded DNA minus the segment targeted for deletion. 4. The PCR plasmid mixture is transformed into wild-type E. coli. The host cell circularizes the deleted plasmid and expressed McrBC nuclease digests the original methylated target plasmid. This leaves only the unmethylated truncated plasmid which is replicated. Linear probes may then be generated from the truncated plasmid, such as by the exemplary method at FIG. 31.

The present disclosure includes methods, compositions, reagents, systems, and kits for rapidly determining the presence of a nucleic acid molecule in a sample. The methods, compositions, reagents, systems, and kits may be used for clinical diagnostic purposes, including but not limited to the detection and identification of pathogenic organisms and the detection of a genetic predisposition to a particular disease.

In an aspect, nucleic acid probes are disclosed, said probes having the ability to detect a first HPV nucleic acid without substantially cross-reacting with a second HPV nucleic acid.

In one aspect, said nucleic acid probes are generated by a method comprising: a) providing a template nucleic acid comprising a sequence at least 1 kilobase in length sharing from about 70% to 100% identity with the first nucleic acid; b) comparing the sequence of the template nucleic acid with the sequence of the second nucleic acid; and c) truncating any regions of the template nucleic acid that share from about 70% to 100% identity with a region of the second nucleic acid.

In an aspect, the present disclosure provides for a nucleic acid comprising a sequence at least 1 kilobase in length sharing 70% or more; 75% or more, 80% or more, 85% or more, 90% or more, 95% or more, 98% or more, or 100% identity to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 116, or SEQ ID NO: 117, or a complement thereof, with the proviso that said nucleic acid does not comprise any sequences sharing 70% or more; 75% or more, 80% or more, 85% or more, 90% or more, 95% or more, 98% or more, or 100% identity with SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 111, SEQ ID NO: 112, SEQ ID NO: 113, SEQ ID NO: 114, SEQ ID NO: 115, or a complement thereof.

The present disclosure also provides for a probe set of one or more probes comprising, consisting essentially of, or consisting of a nucleic acid sharing 70% or more; 75% or more, 80% or more, 85% or more, 90% or more, 95% or more, 98% or more, or 100% identity to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 116, or SEQ ID NO: 117, or a complement thereof, with the proviso that said nucleic acid does not comprise any sequences sharing 70% or more; 75% or more, 80% or more, 85% or more, 90% or more, 95% or more, 98% or more, or 100% identity with SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 111, SEQ ID NO: 112, SEQ ID NO: 113, SEQ ID NO: 114, SEQ ID NO: 115, or a complement thereof.

In a further aspect, the probe set comprises at least one nucleic acid probe comprising, consisting essentially of, or consisting of a sequence sharing 70% or more; 75% or more, 80% or more, 85% or more, 90% or more, 95% or more, 98% or more, or 100% identity with a sequence selected from the group consisting of SEQ ID NO: 97, SEQ ID NO: 98, SEQ ID NO: 99, SEQ ID NO: 100, SEQ ID NO: 101, SEQ ID NO: 102, or SEQ ID NO: 103, OR SEQ ID NO: 117, SEQ ID NO: 117, or a complement thereof.

In an aspect, the present disclosure provides for a nucleic acid comprising, consisting essentially of, or consisting of a sequence sharing 75% or more, 80% or more, 85% or more, 90% or more, 95% or more, 98% or more, or 100% identity to SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 97, SEQ ID NO: 98, SEQ ID NO: 99, SEQ ID NO: 100, SEQ ID NO: 101, SEQ ID NO: 102, SEQ ID NO: 103, OR SEQ ID NO: 117, SEQ ID NO: 117, or fragments or complements thereof.

In one aspect, the present disclosure provides a method for determining the presence of a target nucleic acid molecule in a sample. The method includes:
  a) suspending the sample in a collection medium comprising a detergent;
  b) denaturing the target nucleic acid molecule;
  c) contacting one or more polynucleotide probes with the target nucleic acid molecule under conditions that allow the probes and the target nucleic acid molecule to hybridize, thereby forming a double-stranded nucleic acid hybrid;
  d) capturing the double-stranded nucleic acid hybrid on a solid support coated with a first antibody specific for the double-stranded hybrid nucleic acid hybrid, thereby forming a double-stranded nucleic acid hybrid/solid support complex;
  e) separating the double-stranded nucleic acid hybrid/solid support complex from unbound nucleic acid;
  f) conjugating the complex with a second antibody that is specific for either the double-stranded nucleic acid hybrid or specific for the first antibody to form a double-stranded nucleic acid hybrid/solid support antibody complex; wherein the second antibody is labeled with a detectable marker;
  g) washing the double-stranded nucleic acid hybrid/solid support antibody complex with a wash buffer comprising a detergent; and
  h) detecting the label on the second antibody wherein the detecting indicates the presence of the target nucleic acid molecule.

In another aspect, the present disclosure provides a method for determining the presence of a target nucleic acid molecule in a sample including suspending a sample in a collection medium including a detergent; denaturing a target nucleic acid molecule; contacting one or more polynucleotide probes with the target nucleic acid molecule under conditions that allow the probes and the target nucleic acid molecule to hybridize or bind, and capturing the double-stranded nucleic acid hybrid on a solid support coated with a first antibody specific for the double-stranded hybrid nucleic acid hybrid.

In an aspect, the present disclosure provides a method for determining the presence of a target nucleic acid molecule in a sample including suspending a sample in a collection medium including a detergent; denaturing a target nucleic acid molecule; contacting one or more polynucleotide probes with the target nucleic acid molecule under conditions that allow the probes and the target nucleic acid molecule to hybridize or bind, capturing the double-stranded nucleic acid hybrid on a solid support coated with a first antibody specific for the double-stranded hybrid nucleic acid hybrid and separating the double-stranded nucleic acid hybrid/solid support complex from unbound nucleic acid.

In an aspect, the present disclosure provides a method for determining the presence of a target nucleic acid molecule in a sample including suspending a sample in a collection medium including a detergent; denaturing a target nucleic acid molecule; contacting one or more polynucleotide probes with the target nucleic acid molecule under conditions that allow the probes and the target nucleic acid molecule to hybridize or bind, capturing the double-stranded nucleic acid hybrid on a solid support coated with a first antibody specific for the double-stranded hybrid nucleic acid hybrid, thereby forming a double-stranded nucleic acid hybrid/solid support complex; and separating the double-stranded nucleic acid hybrid/solid support complex from unbound nucleic acid; conjugating the complex with a second antibody that is specific for either the double-stranded nucleic acid hybrid or specific for the first antibody to form a double-stranded nucleic acid hybrid/solid support antibody complex.

In another aspect, the present disclosure provides a method for determining the presence of a target nucleic acid molecule in a sample including suspending a sample in a collection medium including a detergent; denaturing a target nucleic acid molecule; contacting one or more polynucleotide probes with the target nucleic acid molecule under conditions that allow the probes and the target nucleic acid molecule to hybridize or bind, capturing the double-stranded nucleic acid hybrid on a solid support coated with a first antibody specific for the double-stranded hybrid nucleic acid hybrid, thereby forming a double-stranded nucleic acid hybrid/solid support complex; and separating the double-stranded nucleic acid hybrid/solid support complex from unbound nucleic acid; conjugating the complex with a second antibody that is specific for either the double-stranded nucleic acid hybrid or specific for the first antibody to form a double-stranded nucleic acid hybrid/solid support antibody complex; wherein the second antibody is labeled with a detectable marker; and washing the double-stranded nucleic acid hybrid/solid support antibody complex with a wash buffer comprising a detergent.

In another aspect, the present disclosure provides a method for determining the presence of a target nucleic acid molecule in a sample, the method comprising:
  a) suspending the sample in a collection medium comprising a detergent;
  b) denaturing the target nucleic acid molecule in the sample;
  c) forming a double-stranded nucleic acid hybrid by contacting at least one polynucleotide probe with the target nucleic acid molecule;
  d) forming a double-stranded nucleic acid hybrid-support complex by capturing the double-stranded nucleic acid hybrid on a support, wherein the support comprises a first antibody;
  e) forming a double-stranded nucleic acid hybrid-support-second antibody complex by contacting the double-stranded nucleic acid hybrid-support complex with a second antibody, wherein the second antibody is labeled with a detectable marker;
  f) washing the double-stranded nucleic acid hybrid-support-second antibody complex with a wash buffer; and
  g) detecting the marker on the second antibody wherein the detecting indicates the presence of the target nucleic acid molecule.

In an aspect, the polynucleotide probes used in the methods described herein are HPV high-risk strategically-truncated probes. In another aspect, the polynucleotide probes are HPV high risk probes and the deleted portion exhibits high sequence identity or cross reactivity to a HPV low risk type. In an aspect, the HPV high risk probe is specific for or capable of hybridizing to one or more of HPV types 16, 18, 26, 31, 33, 35, 39, 45, 51, 52, 56, 58, 59, 66, 68, 73, and 82 and the deleted portion shares cross reactivity or specificity with one or more of low risk HPV types 1, 2, 3, 4, 5, 6, 8, 11, 13, 30, 34, 40, 42, 43, 44, 53, 61, 67, 69, 70, 71, 72, 74, 81, 83, 84, and 89. In another aspect, the polynucleotide probes comprise, consist, or consist essentially of a sequence sharing 75% or more, 80% or more, 85% or more, 90% or more, 95% or more, 98% or more, or 100% identity to SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, or SEQ ID NO: 95, SEQ ID NO: 97, SEQ ID NO: 98, SEQ ID NO: 99, SEQ ID NO: 100, SEQ ID NO: 101, SEQ ID NO: 102, or SEQ ID NO: 103, OR SEQ ID NO: 117, SEQ ID NO: 117, or fragments or complements thereof.

In one aspect, the solid support includes a modified paramagnetic bead that is coated or has attached thereto a first antibody immunospecific for double-stranded hybrid nucleic acids. A magnetic field can be used to separate the double-stranded nucleic acid-magnetic bead-antibody complex from non-bound nucleic acid.

In an aspect, the method does not include a sample pretreatment step. For example, the detergent-based collection medium allows for reduced sample preparation time which, in turn, can lead to accelerated detection of target nucleic acid molecules. The sample can be analyzed by methods, assays, or the apparatus of the disclosure in a direct-to-assay manner. In an example, purification steps are not performed on the sample prior to evaluation using assays of the disclosure. In an aspect, crude lysate is directly analyzed by the methods, assays, or the apparatus of the disclosure. In another aspect, the sample does not undergo a target amplification step.

One aspect relates to a method of diagnosing cancer by utilizing methods, kits, assays, and the apparatus provided herein. In one aspect, cervical cancer is detected by identifying nucleic acid molecules associated with HPV and HPV variants. In another aspect, cervical intraepithelial neoplasia (CIN) can be screened for using methods, kits, assays, and the apparatus provided herein. The detected cancer can be subsequently treated after being diagnosis by the methods, kits, assays, and the apparatus provided herein. In an aspect, the diagnosed cancer is cervical cancer and variants thereof.

In an aspect, the disclosure provides for a composition comprising
  (a) a biological sample suspended in about 0.5% to about 2.0% NP-40, about 0.10% to about 0.40% sodium deoxycholate, about 25 mM to about 75 mM Tris-HCl, about 10 mM to about 50 mM EDTA, about 50 mM to about 200 mM NaCl, and about 0.01% to about 0.10% sodium azide; and
(b) one or more polynucleotide probes.

In an aspect, the disclosure provides for a composition comprising
(a) a biological sample suspended in a collection medium comprising about 0.5% to about 2.0% NP-40, about 0.10% to about 0.40% sodium deoxycholate, about 25 mM to about 75 mM Tris-HCl, about 10 mM to about 50 mM EDTA, about 50 mM to about 200 mM NaCl, and about 0.01% to about 0.10% sodium azide;
(b) one or more polynucleotide probes; and
(c) a first antibody.

In an aspect, the disclosure provides for a composition comprising
(a) a biological sample suspended in a collection medium comprising about 0.5% to about 2.0% NP-40, about 0.10% to about 0.40% sodium deoxycholate, about 25 mM to about 75 mM Tris-HCl, about 10 mM to about 50 mM EDTA, about 50 mM to about 200 mM NaCl, and about 0.01% to about 0.10% sodium azide;
(b) one or more polynucleotide probes;
(c) a first antibody; and
(d) a second antibody.

In an aspect, the disclosure provides for a composition comprising
(a) a biological sample suspended in a collection medium comprising about 0.5% to about 2.0% NP-40, about 0.10% to about 0.40% sodium deoxycholate, about 25 mM to about 75 mM Tris-HCl, about 10 mM to about 50 mM EDTA, about 50 mM to about 200 mM NaCl, and about 0.01% to about 0.10% sodium azide;
(b) one or more polynucleotide probes;
(c) a support coated with a first antibody; and
(d) a second antibody.

In an aspect, the disclosure provides for a composition comprising
(a) a biological sample suspended in a collection medium, wherein the collection medium comprises at least one detergent;
(b) a denaturation reagent;
(c) one or more polynucleotide probes;
(d) a support coated with a first antibody; and
(e) a second antibody labeled with a detectable marker.

In an aspect, the polynucleotide probes used in the compositions described herein are HPV high-risk strategically-truncated probes. In another aspect, the polynucleotide probes are HPV high risk probes and the deleted portion exhibits high sequence identity or cross reactivity to a HPV low risk type. In an aspect, the HPV high risk probe is specific for or capable of hybridizing to one or more of HPV types 16, 18, 26, 31, 33, 35, 39, 45, 51, 52, 56, 58, 59, 66, 68, 73, and 82 and the deleted portion shares cross reactivity or specificity with one or more of low risk HPV types 1, 2, 3, 4, 5, 6, 8, 11, 13, 30, 34, 40, 42, 43, 44, 53, 61, 67, 69, 70, 71, 72, 74, 81, 83, 84, and 89. In another aspect, the polynucleotide probes are nucleic acid sequences sharing 75% or more, 80% or more, 85% or more, 90% or more, 95% or more, 98% or more, or 100% identity to SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, or SEQ ID NO: 95, SEQ ID NO: 97, SEQ ID NO: 98, SEQ ID NO: 99, SEQ ID NO: 100, SEQ ID NO: 101, SEQ ID NO: 102, or SEQ ID NO: 103, OR SEQ ID NO: 117, SEQ ID NO: 117, or fragments or complements thereof.

As used herein, the phrase "high risk HPV" refers to HPV types associated with an elevated risk of developing cancer, which are well known to a person having ordinary skill in the art.

As used herein, the phrase "low risk HPV" refers to HPV types that are not associated with an elevated risk of developing cancer, which are well known to a person having ordinary skill in the art.

In an aspect, any of the above compositions may be used may be used with any of the collection mediums described herein. In an aspect, the biological sample in the above compositions is a cervical cell sample or a human cervical cell sample. In another aspect, the nucleic acid molecules in the biological sample are denatured. The biological sample in the above compositions can exhibit stability when stored in the collection medium for at least 21 days at 33° C. In an aspect, the second antibody is labeled with a detectable marker.

Biological Sample

Methods of the present disclosure may be used to detect the presence of a target nucleic acid molecule from samples, including, without limitation, a specimen or culture (e.g., cellular, microbiological and viral cultures) including biological and environmental samples. Biological samples may be from an animal, including a human, fluid, solid (e.g., stool) or tissue, as well as liquid and solid food and feed products and ingredients such as dairy items, vegetables, meat and meat by-products, and waste. Environmental samples include environmental material such as surface matter, soil, water and industrial samples, as well as samples obtained from food and dairy processing instruments, apparatus, equipment, utensils, disposable and non-disposable items.

The biological samples may include, but are not limited to, cervical epithelial cells (e.g., a sample obtained from a cervical swab), adenoid cells, anal epithelial cells, blood, saliva, cerebral spinal fluid, pleural fluid, milk, lymph, sputum and semen. The sample may comprise a double-stranded nucleic acid molecule or may comprise a single-stranded nucleic acid molecule. If a double-stranded nucleic acid molecule is present, it may be prepared for hybridization analysis by a variety of methods known in the art, e.g., using alkali, using proteinase K/SDS, chaotropic salts. The process of preparing a double-stranded nucleic acid molecule for hybridization analysis generally involves converting it into a single-stranded nucleic acid molecule. This process is generally known as denaturation. However, it is also contemplated that a double-stranded nucleic acid molecule may be detected without denaturation, e.g., through a triple-stranded construct.

The target nucleic acid molecule in a sample can be DNA or RNA or both DNA and RNA. The target nucleic acid molecule can be contained within a larger nucleic acid molecule. Detection of either the target nucleic acid molecule or the larger nucleic acid molecule containing the target nucleic acid molecule is contemplated by this disclosure.

The biological sample may comprise cervical cells, especially human cervical cells. The sample can be collected with any method or device known in the art, including a chemically inert collection device such as a DACRON tipped swab. Other acceptable collection devices may be used including, but not limited to, cotton swab, cervical brush, flocked swab (a swab shaped like a DACRON swab but made with nylon fibers enabling collection of more cells and easier release of cells), cervical broom, mini broom, lavage, or any collection device often used in Pap smear testing.

In an aspect, the methods include collecting a sample from a woman at least 30 years of age. The method can also include collecting a sample from a woman at least 30 years via a Pap smear or comparable test. The sample collected by the Pap smear or comparable test can be a cervical cell sample.

Once the sample is collected, it may be placed in a sample tube. The tube can be sealed to prevent contamination. The collection device (swab, brush, etc.) may further contain a mechanism by which it can be moved once it is inside the sample tube. In one aspect, the collection device contains an insert that can be moved using a magnet. In one aspect, this insert comprises a metal. In another aspect, this insert comprises a magnetic material. Magnetic material includes paramagnetic, ferromagnetic, and diamagnetic materials. One advantage of moving the collection device once it is inside the sample tube is to avoid the collection device from making contact with any sample extraction or sample detection devices. Examples of a sample extraction device include pipettes, automated pipettor, and pipette tips. Examples of sample detection devices include probes and probe tips.

Sample Tube

Any type of sample tube may be used. The sample tube may be closed or sealed to minimize contamination. The closure may be permanent or removable. Examples of removable closures include snap caps, screw caps, rubber septa, foil, and film. The closure may contain one or more openings or perforations, which when pierced may be re-sealable. One advantage of a closure that contains such openings or perforations is that the closure is not rendered ineffective when pierced by, for example, a sample extraction device or sample detection device. Once the sample extraction device or sample detection device is removed, the closure re-seals, thereby minimizing contamination.

Storage of the Biological Sample

Once the sample is in the sample tube, the sample may be stored by drying it with a substrate, or in a preservative medium, or both. Desiccation is accomplished by pressure drying or drying with chemicals. This removes most of the water and is suitable for long-term stability. Alternatively, the sample may be lyophilized (freeze-dried) with a substrate like trehalose to ensure stability of the sample.

Another possibility is that the sample may be stored by suspending in a preservative medium, known and apparent to one of skill in the art. The purpose of the preservative medium is to protect biological components that can degrade. For instance, the sample cells, the probe mixture, the antibody:bead complex used in the capture step, and the secondary antibody used in the detection step are all susceptible to degradation. A preservative medium at the initial step of collection ideally provides sample stability and integrity and can affect downstream steps in the process of nucleic acid capture and detection.

Collection Medium

In an aspect, the sample may be collected and stored in a collection medium. The collection medium has several functions including as a preservative medium to preserve nucleic acids and inhibit nucleases to prevent degradation of nucleic acids prior to analysis. In one aspect, the collection medium contains at least one detergent. In another aspect, the collection medium contains at least two detergents, at least three detergents, or at least four detergents. In an aspect, each of the detergents is different. In another aspect, the detergent-based collection medium comprises two different detergents, one which is able to control background signal and another detergent that improves magnetic bead behavior, for example, migration through a viscous sample, collection, i.e., how well the magnetic beads gather together at the bottom of the sample well, and retention, i.e., how well the magnetic beads stay in place when a supernatant is either removed from a container containing the sample.

In an aspect, heat is employed during the hybridization, capture, and detection steps of the assay. Even with detergent and the application of heat, antibodies used in the assay remain functional.

The detergent-based collection medium may comprise, consist essentially of, or consist of one, two, three, or four or more detergents. Detergents are known in the art and may include, but are not limited to, cationic detergents such as but not limited to cetyl pyridinium bromide, cetyltrimethylammonium bromide (collectively known as cetrimonium compounds) and alkylbenzyldimethylammonium chlorides (collectively known as benzalkonium compounds), and alkyl-trimethyl-ammonium salts; anionic detergents such as, but not limited to, sodium dodecyl sulfate (SDS), and Sarkosyl; and non-denaturing detergents such as NP-40; and other detergents. NP-40 is also known as Tergitol-type NP-40, which is nonyl phenoxylpolyethoxylethanol. NP-40 is not powerful enough to break the nuclear membrane, but can break the plasma membrane. As such, it can be used to obtain the cytoplasmic contents of a cellular culture.

Other detergents and combination of detergents may be used, and their combination provides the ability to control background noise and improve magnetic bead behavior (when the solid support employed comprises magnetic beads). In certain aspects, one detergent is an anionic detergent and the second detergent is a nonanionic detergent. For example, in one aspect, the combination of non-ionic and anionic detergents helps to maintain low-background noise. In an aspect, a detergent-based collection medium comprises an anionic detergent such as sodium deoxycholate, which controls background noise and NP-40, which may improve magnetic bead behavior.

The combination of these two types of detergents provides synergistic benefits beyond a simple combination of adding two detergents together: control of background noise, better bead behavior, and increased assay speed. The presence of these detergents (in the detergent-based collection medium) provides the ability to achieve faster assay results, but does not negatively impact the nucleic acid or capture antibody during downstream analytical steps.

In addition, the detergent-based collection medium improves removal of the specimen from the collection device as the sample is dissolved more easily. In addition, the detergent-based collection medium improves the homogeneity of the sample compared with other collection media such as but not limited to PRESERVCYT (uses a 40% methanol solution), STM (uses a chaotropic agent), and alcohol. The detergent-based collection medium also reduced sample viscosity after mixing (either manual or automated).

The concentration of NP-40 in the collection medium can range from about 0.5% to about 2.0%, from about 0.1% to about 1.0%, as well as any number within the recited ranges. In certain aspects, the NP-40 is present at a concentration from about 0.8% to about 1.5%; from about 0.9% to about 1.2% and in certain aspects is about 1.0%. In another aspect, the NP-40 is present at a concentration from about 0.1%, about 0.2%, about 0.3%, about 0.4%, about 0.5%, about 0.6%, about 0.7%, about 0.8%, about 0.9%, about 1.0%, about 1.1%, about 1.2%, about 1.3%, about 1.4%, about 1.5%, about 1.6%, about 1.7%, about 1.8%, about 1.9%, or about 2.0%. The concentration of sodium deoxycholate in the collection medium can range from about 0.10% to about 0.40%, from about 0.20% to about 0.30%, as well as any number within the recited ranges. In one aspect, the concentration of sodium deoxycholate is about 0.10%, about 0.15%, about 0.20%, about 0.25%, about 0.30%, about 0.35%, or about 0.40%.

The detergent-based collection medium may comprise, consist essentially of, or consist of a buffer, two detergents, a chelator and a preservative. The buffer may be Tris-HCl in a concentration of from about 25 mM to about 75 mM; from about 30 mM to about 60 mM; from about 40 mM to about 50 mM, and from about 45 mM to about 55 mM as well as any number within the recited ranges. The buffer may also be Tris-HCl in a concentration of about 25 mM, about 30 mM, about 35 mM, about 40 mM, about 45 mM, about 50 mM, about 55 mM, about 60 mM, about 65 mM, about 70 mM, or about 75 mM.

Any preservative can be used and the choice can depend on factors such as desired functionality, minimization side-effects, cost, etc. Suitable preservatives include gentomycin, ProClin, dimersol, and sodium azide. The concentration of the preservative in the collection medium depends on factors such as the type of preservative, its efficacy, its side-effects, etc. For example, for sodium azide, the concentration of sodium azide can range from about 0.01% to about 0.1%, from about 0.025% to about 0.075%, and from about 0.04% to about 0.06%, as well as any number within the recited ranges. The preservative, for example, sodium azide, can also be present at about 0.01%, about 0.02%, about 0.03%, about 0.04%, 0.05%, about 0.06%, about 0.07%, about 0.08%, about 0.09%, or about 0.10%.

In one aspect the detergent-based collection medium comprises, consists essentially of, or consists of 1.0% NP-40, 0.25% sodium deoxycholate, 50 mM Tris-HCl, 25 mM EDTA, 150 mM NaCl and 0.09% sodium azide. In another aspect the detergent-based collection medium comprises, consists essentially of, or consists of about 0.5% to about 2.0% NP-40, about 0.10% to about 0.40% sodium deoxycholate, about 25 mM to about 75 mM Tris-HCl, about 10 mM to about 50 mM EDTA, about 50 mM to about 200 mM NaCl, and about 0.01% to about 0.10% sodium azide. In other aspects the detergent-based collection medium comprises, consists essentially of, or consists of about 0.8% to about 1.5% NP-40, about 0.20% to about 0.40% sodium deoxycholate, about 30 mM to about 60 mM Tris-HCl, about 20 mM to about 40 mM EDTA, about 100 mM to about 200 mM NaCl, and about 0.025% to about 0.075% sodium azide. In yet another aspect the detergent-based collection medium comprises, consists essentially of, or consists of about 0.9% to about 1.2% NP-40, about 0.20% to about 0.30% sodium deoxycholate, about 30 mM to about 60 mM Tris-HCl, about 20 mM to about 30 mM EDTA, about 100 mM to about 150 mM NaCl, and about 0.04% to about 0.06% sodium azide.

In an aspect, the collection medium comprises, consists essentially of, or consists of NP-40 and EDTA. In another aspect, the collection medium comprises, consists essentially of, or consists of NP-40, EDTA, and sodium azide. In one aspect, the collection medium comprises, consists essentially of, or consists of sodium deoxycholate, EDTA, and sodium azide. In an aspect, the collection medium comprises, consists essentially of, or consists of about NP-40, sodium deoxycholate, EDTA, and sodium azide. In an aspect, the collection medium comprises, consists essentially of, or consists of NP-40, sodium deoxycholate, Tris-HCl, EDTA, and sodium azide.

In another aspect, the collection medium comprises, consists essentially of, or consists of 0.5% to about 2.0% NP-40 and 10 mM to about 50 mM EDTA. In another aspect, the collection medium comprises, consists essentially of, or consists of 0.5% to about 2.0% NP-40, 10 mM to about 50 mM EDTA, and about 0.01% to about 0.10% sodium azide. In one aspect, the collection medium comprises, consists essentially of, or consists of about 0.10% to about 0.40% sodium deoxycholate, 10 mM to about 50 mM EDTA, and about 0.01% to about 0.10% sodium azide. In an aspect, the collection medium comprises, consists essentially of, or consists of about 0.5% to about 2.0% NP-40, about 0.10% to about 0.40% sodium deoxycholate, 10 mM to about 50 mM EDTA, and about 0.01% to about 0.10% sodium azide. In an aspect, the collection medium comprises, consists essentially of, or consists of about 0.5% to about 2.0% NP-40, about 0.10% to about 0.40% sodium deoxycholate, about 25 mM to about 75 mM Tris-HCl, about 10 mM to about 50 mM EDTA, and about 0.01% to about 0.10% sodium azide.

In an aspect, the collection medium is a non-chaotropic medium. That is, for example, the collection medium does not include a chaotropic medium or chaotropic salts. Without being limited, in an aspect, the collection medium does not include guanidine hydrochloride or urea. A potential advantage of using a non-chaoptropic collection medium is better resuspension of a sample, more reproducible testing, and more uniform testing aliquots relative to a medium which includes a chaotropic medium or chaotropic salts.

An advantage of using a detergent-based collection medium is that it preserves the stability of the sample. A sample stored in a detergent-based collection medium as disclosed is stable for at least 31 days, and, when held at temperatures from 15° C. to 33° C. is stable for at least 21 days. In an aspect, a sample is stable when frozen in a detergent-based collection medium at −20° C. for at least six months. In another aspect, a cervical cell sample is stable for at least 31 days, for at least 21 days when held at temperatures from 15° C. to 33° C., and for at least 6 months in a detergent-based collection medium at −20° C.

A detergent-based collection medium also leads to improved assay performance under rigorous hybridization and capture conditions (for example, at temperatures between 65°-75°) relative to collection medium containing a denaturant.

The presence of one, two, three, four or more detergents can reduce sample viscosity, which aids in the removal of the liquid phase from the magnetic beads, as well as aids in the mixing of samples.

In one aspect, a sample such as blood or an exfoliated cervical cell specimen can be collected and suspended in a detergent-based collection medium. The sample can be is collected with a chemically inert collection device such as a DACRON tipped swab. Any other suitable swab may be used such as nylon fiber swabs. The sample may be stored in a detergent-based collection medium, to prevent degradation of nucleic acids prior to analysis and to maintain stability of the sample.

Samples may be collected in other known collection mediums and then can be used in the methods described herein. Examples of other collection media include PRESERVCYT, SUREPATH, DIGENE Collection Medium ("DCM"), and STM (Sample/Specimen Transport Medium). Certain collection media are nucleic acid specific. For example DCM is not used when the target nucleic acid is RNA. Samples collected in some of these media may require processing before the nucleic acids in the samples can be detected and analyzed. Various methods of processing samples (also known as preparing the samples) are known in the art. For example, cervical cell samples collected for cytological analysis in medium such as PRESERVCYT may be combined with a detergent-based lysis buffer followed by the addition of magnetic beads comprising nucleic acid binding surfaces. In addition, other cell samples collected in other known commonly available collection mediums may be combined with a detergent-based lysis buffer followed by the addition of magnetic beads comprising nucleic acid binding surfaces.

In another aspect, the lysis buffer includes 150 mM Tris-HCl (pH 8.0), 0.09% (w/v) Sodium Azide, 6% (v/v) Triton x-100, 300 mM Diethanolamine (w/v), with a final pH of between 9.3 and about 9.5. In another yet another aspect, the lysis buffer includes between about 100 mM to about 200 mM Tris-HCl at between about pH 7.5 and about 8.5, between about 0.05% and about 0.10% (w/v) sodium azide, between about 2.5% to about 7.5% (v/v) Triton x-100, and between about 200 mM to about 400 mM Diethanolamine (w/v), with a final pH of between 9.0 and about 10.0.

Pre-Treatment

In an aspect, the assay does not include a sample pre-treatment preparation step. In another aspect, the assay does not include sample pre-treatment preparation when a detergent-based collection medium is used. For example, a sample pre-treatment preparation is not required when the detergent-based collection medium comprises, consists essentially of, or consists of about 0.5% to about 2.0% NP-40, about 0.10% to about 0.40% sodium deoxycholate, about 25 mM to about 75 mM Tris-HCl, about 10 mM to about 50 mM EDTA, about 50 mM to about 200 mM NaCl, and about 0.01% to about 0.10% sodium azide. Any combination of the components is also contemplated.

In another aspect, the assay can include a pre-sample treatment preparation step when either PRESERVCYT or SUREPATH are used as the collection medium. The pre-treating may be done manually or may be automated.

One example of an automated pre-treatment machine is a Pre-Analytic System (PAS) instrument that is adapted to process biological samples, including liquid based cytology (LBC) samples into standard 96-well plates containing the extracted sample nucleic acid. In the PAS, samples are processed in a strip of eight test tubes, called the extraction tube unit (ETU). Each ETU corresponds to a row of a 96-well plate. In an aspect, the throughput of the system is about 35 minutes to the completion of the first ETU with subsequent ETUs completed at about 2 minute intervals.

In order to meet the throughput requirements, the instrument can process ETUs in a parallel manner. Each ETU passes through 10 steps before the processing is complete. These steps are grouped with similar steps to create six processing modules, identified by the station letters. The ETUs are moved between the six stations by a six-axis robot at about two minute intervals. Because of incubation times, some steps require the ETU to remain at the station for more than about two minutes. In this case, additional locations are supplied in the station to accommodate a first-in-first-out process.

The PAS can include several components, such as: 1) an ETU transport mechanism; 2) an ETU and ETU gripper; 3) a magnet station for attracting paramagnetic beads; and 4) a pipettor station that transfers concentrated nucleic acid from ETU to plate. The PAS can produce up to ten 96-well plates of extracted DNA from liquid based cytology samples in less than 5 hours for subsequent analysis in an instrument designed to run the method for determining of the presence of the target nucleic acid molecules. The PAS is designed to address some of the current challenges of extracting DNA from liquid based cytology testing including volume of sample required (4 mL), limited automation and the low throughput of manual sample conversion protocol.

Target Nucleic Acid Molecules

The target nucleic acid molecules include, without limitation, nucleic acid molecules found in specimens or cultures (e.g., cellular, microbiological and viral cultures) including biological and environmental samples. The target nucleic acid molecules may be found in biological samples from an animal, including a human, fluid, solid (e.g., stool) or tissue, as well as liquid and solid food and feed products and ingredients such as dairy items, vegetables, meat and meat by-products, and waste. Target nucleic acid molecules may be found in environmental samples and include environmental material such as surface matter, soil, water and industrial samples, as well as samples obtained from food and dairy processing instruments, apparatus, equipment, utensils, disposable and non-disposable items.

The target nucleic acid molecules found in biological samples include, but not limited to cervical samples (e.g., a sample obtained from a cervical swab) or cervical cell samples, adenoid cells, anal epithelial cells, blood, saliva, cerebral spinal fluid, pleural fluid, milk, lymph, sputum, urine and semen. The target nucleic acid molecules may be from other viral, bacteria, mycobacteria or plasmodia, for example cytomegalovirus (CMV), herpes, HIV, H1N1, chlamydia, gonorrhea, *Trichomonas vaginalis, Staphylococcus aureus,* tuberculosis, SARS-associated coronavirus or influenza. In an aspect the target nucleic acid molecules are 75% or more, 80% or more, 85% or more, 90% or more, 95% or more, 98% or more, or 100% identical to nucleic acid molecules associated with any one of cervical samples (e.g., a sample obtained from a cervical swab) or cervical cell samples, adenoid cells, anal epithelial cells, blood, saliva, cerebral spinal fluid, pleural fluid, milk, lymph, sputum, urine and semen, other viral, bacteria, mycobacteria or plasmodia, for example cytomegalovirus (CMV), herpes, HIV, H1N1, chlamydia, gonorrhea, *Neisseria gonorrhoeae* (GC), *Chlamydia trachomatis* (CT), *Trichomonas vaginalis, Staphylococcus aureus,* tuberculosis, SARS-associated coronavirus or influenza.

In one aspect, the target nucleic acid molecules are human papillomavirus (HPV) and include genetic variants of HPV. A variant includes polymorphisms, mutants, derivatives, modified, altered, or the like forms of the target nucleic acid. In one aspect, the target nucleic acid is an HPV nucleic acid. In another aspect, the HPV nucleic acid is HPV DNA of a high risk HPV type. In another aspect, the HPV nucleic acid is HPV RNA of a high risk HPV type. In another aspect the target nucleic acids are any one of high risk HPV types 16, 18, 26, 31, 33, 35, 39, 45, 51, 52, 56, 58, 59, 66, 68, 73, and 82 or any one of low risk HPV types 1, 2, 3, 4, 5, 6, 8, 11, 13, 30, 34, 40, 42, 43, 44, 53, 61, 67, 69, 70, 71, 72, 74, 81, 83, 84, and 89.

In another aspect, the target nucleic acid molecule is 75% or more, 80% or more, 85% or more, 90% or more, 95% or more, 98% or more, or 100% identity to nucleic acid molecules associated with any one of HPV, genetic variants of HPV, HPV DNA of a high risk HPV type, or HPV RNA of a high risk HPV type. In another aspect the target nucleic acids are 75% or more, 80% or more, 85% or more, 90% or more, 95% or more, 98% or more, or 100% identical to nucleic acid molecules associated with any one of high risk HPV types 16, 18, 26, 31, 33, 35, 39, 45, 51, 52, 56, 58, 59, 66, 68, 73, and 82 or any one of low risk HPV types 1, 2, 3, 4, 5, 6, 8, 11, 13, 30, 34, 40, 42, 43, 44, 53, 61, 67, 69, 70, 71, 72, 74, 81, 83, 84, and 89.

As noted previously, the target nucleic acid molecule may be DNA or RNA. When the target nucleic acid molecule is DNA, the probe is preferably RNA and when the target nucleic acid is RNA, the probe is preferably DNA. However, a DNA probe can be used with DNA target nucleic acid molecule and an RNA probe can be used with RNA target nucleic acid molecule. Also as indicated previously, the target nucleic acid molecule may determine the collection medium used.

Denaturation

After the sample is collected in a detergent-based collection medium as described above, the sample may be treated with a denaturation reagent to render the target nucleic acid molecule accessible to hybridization. In one aspect, the sample is denatured with an alkaline solution. Any alkali that can bring a solution pH to about pH 12, about pH 13, or about pH 14 may be used. Additionally, any alkali that can bring a solution pH to a range of about pH 12 to about pH 13, from about pH 12 to about pH 14, and from about pH 13 to about pH 14 can be used. Suitable concentrations of alkali include from about 1.0 N to about 2.0 N, from about 1.25 N to about 1.75 N, and from about 1.25 N to about 1.5 N, and about 1.5 N as well as any number within the recited ranges. Without being limited, suitable alkali include NaOH and KOH.

In one example, the sample suspended in a detergent-based collection medium can be treated with about one-half volume of 1.75 N NaOH solution. For example, in certain aspects approximately a 50 µl aliquot is removed from a sample suspended in a detergent-based collection medium and approximately 25 µl of 1.75 N NaOH solution is added to the 50 µl aliquot sample. The sample treated with the denaturation reagent can be mixed by hand mixing or mechanical shaking at about 800 rpm, about 900 rpm, about 1000 rpm, between about 600 and about 1000 rpm, or between about 600 and 1200 rpm. In an aspect, the pH of the sample after addition of denaturation reagent can be about 14. In another aspect, the pH can be about pH 12 or pH 13. Such basic pH will both nick and denature a majority of the nucleic acid in the specimen. In addition, alkaline treatment can disrupt interactions between peptides and nucleic acids to improve accessibility of the target nucleic acid and degrade protein.

Alkaline treatment of protein effectively homogenizes the specimen to ensure reproducibility of analysis results for a given sample. It can also reduce the viscosity of the sample to increase kinetics, homogenize the sample, and reduce background by destroying any endogenous single stranded RNA nucleic acids, DNA-RNA hybrids or RNA-RNA hybrids in the sample. It also helps inactivate enzymes such as RNases and DNases that may be present in the sample. One skilled in that art would appreciate that if RNA is the target nucleic acid (as opposed to DNA), different reagents may be preferable including, but not limited to phenol extraction and TCA/acetone precipitation, and guanidinium thiocyanate-phenol-chloroform extraction.

Other methods of denaturation may be employed such as utilizing a heating step, for example, heating the sample to about 95° C. to separate the strands of nucleic acid. Enzymes such as helicase may be used as well. The oil may be silicone oil. In one embodiment, an oil or oil-type substance is added to the sample prior to heating. The oil may have a viscosity of about 0.5 Cst to about 20 Cst, about 1.0 Cst to about 10 Cst, or about 2.0 Cst to about 5 Cst. In an aspect, the volume is about 5 Cst. In an aspect about 10 µl to about 45 µl of the above silicone oil is added to 1 mL or more of collection media and evaluated on an automated platform. One advantage of adding an oil is that the sample is heated more evenly.

In one aspect, 1.5 N to 2.0 N NaOH is added to the sample and heated. In another aspect, 1.75 N NaOH is added to the sample and heated. The sample with denaturation reagent may be heated to about 60° C. to about 80° C. for about 30 minutes, to about 65° C. to about 75° C. for about 30 minutes, to about 67° C. to about 70° C. for about 30 minutes, or to about 70° C. for about 30 minutes, or any number within the recited ranges. In another aspect, the sample with denaturation reagent is heated to about 60° C. to about 80° C. for about 20 to about 40 minutes, or to about 65° C. to about 75° C. for about 20 to about 40 minutes, to about 67° C. to about 70° C. for about 20 to about 40 minutes, or to about 70° C. for about 30 minutes, or any number within the recited ranges. A goal of the described time and temperature conditions is to provide for maximal denaturation of the sample in a minimum amount of time, while leaving the target nucleic acid in a suitable condition for carrying out the remaining steps of hybridization, capture, washing, and detection. Therefore, the sample may be heated in denaturation reagent for about 5 to about 120 minutes, about 10 to about 60 minutes, about 20 minutes to about 40 minutes, about 30 minutes, or any number within the recited ranges. It will be readily understood by one of ordinary skill in the art that longer periods of incubation at lower temperatures, or shorter periods of incubation at higher temperatures, may be balanced to provide a similar effect to the conditions described herein.

Hybridization and Binding of Probes

After the sample containing the nucleic acid is denatured, it is contacted with one or more polynucleotide probes under a condition sufficient for the one or more polynucleotide probes to hybridize to the target nucleic acid in the sample to form a double-stranded nucleic acid hybrid. The probe can be full length, truncated, or synthetic DNA or full length, truncated, or synthetic RNA. If the target nucleic acid is DNA, then the probe may be RNA and if the target nucleic acid is RNA, then the probe may be DNA. Preferably, the one or more polynucleotide probes are diluted in a probe diluent that also can act as a neutralizing hybridization buffer (to neutralize the basic denaturation reagent).

The probe diluent used for DNA or RNA probes will differ due to the different requirements necessary for DNA versus RNA stability. For example, if the probes are RNA, it is preferable to neutralize the sample first and than add the probe or alternatively, add the RNA probe and neutralizing agent (probe diluent) to the sample at the same time as NaOH can destroy RNA. The probe diluent can be used to dissolve and dilute the probe and also help restore the sample to about a neutral pH, e.g., about pH 6 to about pH 9, to provide a more favorable environment for hybridization. Sufficient volume of probe diluent, preferably one-half volume of the sample, may be used to neutralize the base-treated sample.

In an aspect, the probe diluent comprises a buffer, polyacrylic acid, NaOH and sodium azide. The probe diluent may comprise acetic acid. In one aspect, the probe diluent comprises 2.2 M BES (N,N-Bis(2-hydroxyethyl)-2-aminoethanesulfonic acid), 2.6% polyacrylic acid (PAA), 0.7 N NaOH and 0.09% sodium azide. The probe diluent may contain from about 1.2 M to about 2.6 M BES, from about 1.5 M to about 2.5 M BES; from about 1.75 M to about 2.25 M BES; from about 2 M to 2.4 M BES, or about 2.2 M BES, as well as any number within the recited ranges. In one aspect the probe diluent may contain from about 2% to about 3.0% PAA or, as well as any number within the recited ranges. In another aspect, the PAA concentration is from about 2.2% to about 2.7%. In yet another aspect, the PAA concentration is about 2.6%. In a further aspect the probe diluent may contain from about 0.6 N to about 0.8 N NaOH, for example, about 0.7 N NaOH. The concentration of NaOH generally increases as the amount of BES increases.

The probe diluent has a viscosity that permits accurate dispensing by automatic pipetting techniques. In other words, the viscosity of the probe diluent is adjusted so that the desired volume can be accurately and automatically pipetted. If the viscosity is too low, the probe diluent cannot form a stable drop. On the other hand, if the viscosity is too high, the probe diluent drop will be too large. When such a drop enters the sample tube, it may cause significant disturbance of the contents already in the sample tube (e.g., by splashing against the walls of the sample tube).

For full length probes, a heated alkaline solution may be added to the sample, then probe diluent may be added to the sample at room temperature, and then the sample may be reheated. Such a process can inhibit secondary structure from forming. Antibodies tend to irreversibly bind to structures with secondary structure. When using non-full length probes such as truncated or synthetic probes, heating the solutions or sample may not be necessary because secondary structures issues are not present. In an aspect, the sample is not heated when used with truncated or synthetic probes.

After treatment with the denaturation reagent, an aliquot of neutralization buffer, in an aspect the probe diluent described, in which the one or more probes are dissolved, can be added to the sample under appropriate conditions to allow hybridization or binding of the probe and the target nucleic acid to occur. The neutralization buffer may contain a single buffering salt. In an aspect, the neutralization buffer does not contain more than a single buffering salt. The hybridization condition is sufficient to allow the one or more polynucleotide probes to anneal to a corresponding complementary nucleic acid sequence, if present, in the sample to form a double-stranded nucleic acid hybrid.

Hybridization conditions suitable for the particular probes and diluents described herein are employed. For example, the probes and sample nucleic acids can be incubated for a hybridization time, preferably at least about 5 to about 30 minutes, about 5 to about 20 minutes, or from about 7 to about 15 minutes, or about 10 minutes, as well as any number within the recited ranges sufficient to allow the one or more polynucleotide probes to anneal to a corresponding complementary nucleic acid sequence. The hybridization condition can include a hybridization temperature of at least about 65° C., about 68.5° C., and about 67° C. to about 70° C., as well as any number within the recited ranges. For a given target nucleic acid and a given probe, one of ordinary skill in the art can readily determine desired hybridization conditions by routine experimentation. One of ordinary skill in the art will further appreciate that the time and temperature of hybridization must be optimized, one with respect to the other. Thus, higher hybridization temperatures may be carried out for shorter periods of time and vice versa. Without being limited, stringent hybridization conditions may be controlled by increasing the temperature, increasing the ionic conditions to above 0.5M (for example, NaCl), or reducing the concentration of PAA. As a non-limiting example, stringent hybridization conditions may include performing a hybridization reaction at elevated temperatures, such as of at least about 65° C., at least about 68.5° C., between about 67° C. to about 70° C., and between about 69° C. to about 70° C. Stringent hybridization conditions may also include elevated temperatures, such as of at least about 65° C., at least about 68.5° C., and between about 67° C. to about 70° C.

In a non-limiting aspect, the probe is capable of hybridizing or binding to nucleic acid molecules 75% or more, 80% or more, 85% or more, 90% or more, 95% or more, 98% or more, or 100% identical to nucleic acid molecules associated with HPV, genetic variants of HPV, HPV DNA of a high risk HPV type, or HPV RNA of a high risk HPV type, or any one of high risk HPV types 16, 18, 26, 31, 33, 35, 39, 45, 51, 52, 56, 58, 59, 66, 68, 73, and 82 or any one of low risk HPV types 1, 2, 3, 4, 5, 6, 8, 11, 13, 30, 34, 40, 42, 43, 44, 53, 61, 67, 69, 70, 71, 72, 74, 81, 83, 84, and 89. In another aspect, the probe is complementary to HPV, genetic variants of HPV, HPV DNA of a high risk HPV type, HPV RNA of a high risk HPV type, or any one of high risk HPV types 16, 18, 26, 31, 33, 35, 39, 45, 51, 52, 56, 58, 59, 66, 68, 73, and 82 or any one of low risk HPV types 1, 2, 3, 4, 5, 6, 8, 11, 13, 30, 34, 40, 42, 43, 44, 53, 61, 67, 69, 70, 71, 72, 74, 81, 83, 84, and 89. In another aspect, the probe is a strategically-truncated probe 75% or more, 80% or more, 85% or more, 90% or more, 95% or more, 98% or more, or 100% identical to SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, or SEQ ID NO: 95, SEQ ID NO: 97, SEQ ID NO: 98, SEQ ID NO: 99, SEQ ID NO: 100, SEQ ID NO: 101, SEQ ID NO: 102, or SEQ ID NO: 103, OR SEQ ID NO: 117, or complements thereof.

In one aspect, the sample is suspended in detergent-based collection medium, the target nucleic acid is denatured with a denaturation reagent, and hybridized to nucleic acid probes suspended in a neutralizing buffer. In another aspect the neutralizing buffer is the probe diluent of the present invention. The probe diluent can comprises 2.2 M BES (N,N-bis(2-hydroxyethyl)-2-aminoethanesulfonic acid), 2.6% polyacrylic acid, 0.7 N NaOH and 0.09% sodium azide.

Capture

After the probes are allowed to hybridize to the target nucleic acid molecule and to form a double-stranded nucleic acid hybrid, the hybrid is captured by a molecule that is specific for the double-stranded nucleic acid hybrid. Molecules specific for the double stranded nucleic acid hybrids include, but are not limited to, monoclonal antibodies, polyclonal antibodies, proteins such as but not limited to RNAse H, nucleic acids including but not limited to aptamers, or sequence specific nucleic acids. Aptamers are short stretches of random sequences that are successively selected from a library of sequences by hybridizing to a target, amplifying the hybridized aptamers, and repeating the selection process. In one aspect the molecule specific for the double stranded nucleic acid hybrid is captured by an antibody, known as an anti-hybrid antibody.

In one aspect, a first anti-hybrid antibody is immobilized onto a support using techniques that are standard in the art. Examples of suitable supports include covalent linkages or adsorption, for example, protein-protein interactions, protein-G beads, biotin-streptavidin interaction, EDAC to link to a carboxyl or tosyl group, etc., or hybridization directly onto the solid support using, for example, sequence specific nucleic acids in an affinity column.

Supports include but are not limited to beads, magnetic beads, which as indicated previously include paramagnetic, diamagnetic, ferromagnetic, ferrimagnetic, and diamagnetic beads, columns, plates, filter paper, polydimethylsiloxane (PDMS), and dipsticks. Any support can be used as long as it allows extraction of the liquid phase and provides the ability to separate out bound and unbound antibodies. Magnetic beads are particularly useful in that they can be left in the solution and the liquid phase can be extracted or decanted, if a magnetic field is applied to immobilize the beads. Beads that are small and have a high surface area are preferable, such as beads about 1 μm in diameter. Other beads that employ charge switching or silica capture (as opposed to magnetic fields) may be used as well.

The hybrids are incubated with the anti-hybrid antibody attached to the support for a sufficient amount of time to allow capture of the double-stranded nucleic acid hybrids by the immobilized anti-hybrid antibodies. In an aspect, the support is a bead.

The anti-hybrid antibody may be monoclonal or polyclonal. In one aspect the antibody is monoclonal. In one aspect, the antibody is coupled to support by an 1-ethyl-3-[3-dimethylaminopropyl]carbodiimide hydrochloride (EDAC)

linker. In one aspect, the support is a polystyrene bead. In an aspect, the support or bead coupled to the antibody is diluted in a bead dilution buffer. The bead dilution buffer is helpful in minimizing protein denaturation on the bead. One example of a bead dilution buffer comprises 6% casein, 100 mM Tris-HCl, 300 mM NaCl, and 0.05% sodium azide.

In an aspect, the beads coated with the anti-hybrid antibody are incubated with the sample at about 67° C. to about 70° C. for about 30 minutes. In another aspect, the beads and sample are incubated at about 68° C. to about 69° C. for about 30 minutes. In yet another aspect, the beads and sample are incubated at about 68.5° C. for 30 minutes. The incubation time can range from about 5 minutes to about 60 minutes, from about 15 minutes to about 45 minutes, from about 20 minutes to about 40 minutes, or any number within the recited ranges, and is generally inversely proportional to the temperature. It will be understood by those skilled in the art that the incubation time, temperature and/or shaking conditions can be varied to achieve alternative capture kinetics as desired.

Following capture of the target nucleic acid/probe hybrid as described above, the captured hybrid may be separated from the rest of the sample by washing away of non-captured nucleic acids.

Conjugation

Another step in the method can involve providing a second antibody that is also specific for double stranded nucleic acids hybrids or alternatively is specific for the first antibody. The second antibody may be detectably labeled, either directly or indirectly, and may be a monoclonal or polyclonal antibody. In an aspect, the second antibody is monoclonal. In another aspect, the second antibody is directly labeled with a detectable marker and is monoclonal. The second antibody is used to detect the presence of double-stranded nucleic acid hybrids. In one aspect, the second antibody has a label that must react with a substrate to provide a signal that can be detected. The second antibody may be dissolved in a suitable buffer. In one aspect the buffer comprises 100 mM TrisHCl, pH 7.4, 0.5 M NaCl, 0.1 mM $ZnCl_2$, 1.0 mM $MgCl_2$, 0.25% Tween 20, 0.2 mg/ml RNase A, 4% hydroxypropyl-b-cyclodextrin (cyclodextrin), 30% bead dilution buffer as discussed previously, 0.05% goat IgG, 0.09% sodium azide. In an aspect, the conjugation reaction takes place at room temperature. In another aspect the conjugation reaction takes place at about 37° C., about 45° C., or about 50° C. In an aspect the conjugation reaction takes place at about 37° C., about 45° C., or about 50° C., between 35° C. and about 40° C., between 40° C. and about 50° C. for between about 20 minutes and 40 minutes. In an aspect the conjugation reaction takes place at about 37° C., about 45° C., or about 50° C. for between about 20 minutes and 40 minutes. In another aspect the conjugation reaction takes place at about 45° C. for about 30 minutes.

It will be understood by those skilled in the art that any detectable label such as, but not limited to, an enzyme, radioactive molecule, fluorescent molecule, or metal particle such as gold particle can be used. In certain aspects, the detectable label is alkaline phosphatase. Methods of conjugating a label to an antibody are known. For example, an antibody can be reduced with dithiothreitol (DTT) to yield monovalent antibody fragments. The reduced antibody can then be directly conjugated to maleinated alkaline phosphatase by the methods of Ishikawa et al., J. Immunoassay 4:209-237 (1983) and Means et al., Chem. 1: 2-12 (1990), the contents of each of which are incorporated herein by reference in its entirety, and the resulting conjugate can be purified by HPLC. The conjugate may also be purified using any type of size-exclusion chromatography. One benefit of purification is that the conjugates of one protein to one antibody can be separated from those conjugates with other ratios of protein to antibody.

In another aspect, the double-stranded nucleic acid hybrids can be detected with a second anti-hybrid antibody that is not directly labeled. For example, the second antibody can be a mouse immunoglobulin that is detected by a labeled goat anti-mouse antibody.

Wash

Following conjugation with the second antibody, the sample is washed with a based wash buffer. The wash buffer may contain one or more detergents or may be free of a detergent. If the wash buffer contains a detergent, the detergent may be an ionic or a non-ionic detergent. One example of a non-ionic detergent is Triton-X. The detergent may be present in the wash buffer at a concentration of about 0.05% to about 1.5%, or from about 0.075% to about 1.0%, or from about 0.1% to about 0.75%, or about 0.5% or any number within the recited ranges. One example of a suitable wash buffer comprises 40 mM Tris, pH 8.2, 100 mM NaCl, 0.5% Triton-X 100 and 0.05% sodium azide.

In an aspect, the wash buffer contains 0.5 mM to about 2.0 mM Tris and 0.02-0.10% sodium azide at a pH between about 7.5 to about 8.5. In another aspect, the wash buffer comprises, consists essentially of, or consists of about 0.5 mM to about 2.0 mM Tris and 0.02-0.10% sodium azide at a pH between about 7.5 to about 8.5. In yet another aspect, the wash buffer comprises, consists essentially of, or consists of about 1.0 mM Tris and about 0.09% sodium azide. In an aspect, the wash buffer has a pH of between about 7.6 to about 8.4.

The sample may be washed with the wash buffer from one to ten times, or from three to seven times, or from four to six times, four times, or five times, or any number within the recited ranges. In an aspect, the sample is washed at least four times with two different wash buffers. In another aspect, the sample is washed at least four times with three washes taking place with one buffer and another wash step taking place with a different buffer. The sample may also be washed with a single wash buffer or with multiple wash buffers. Each wash may use the same wash buffer or a different wash buffer. For example, a detergent-containing wash buffer may be used for one wash while a detergent-free wash buffer may be used for another wash. In an aspect, one of the wash buffers does not include Triton.

Detection

The label present on the second, or third, or more, antibody is detected to thus indicate the presence of the target nucleic acid molecule. Methods for detecting various labels are known in the art. For example, colorimetry, radioactive, surface plasmon resonance, or chemiluminescence methods are described by e.g., Coutlee et al., J. Clin. Microbiol. 27:1002-1007 (1989), the contents of which are incorporated herein by reference in its entirety.

For example, a bound alkaline phosphatase conjugate can be detected by chemiluminescence with a reagent such as a LUMI-PHOS 530 reagent (Lumigen, Detroit, Mich.) or DR2 (Applied Biosystems, Foster City, Calif.) using a detector such as an E/LUMINA luminometer (Source Scientific Systems, Inc., Garden Grove, Calif.), an OPTOCOMP I Luminometer (MGM Instruments, Hamden, Conn.), or the like, such as a Veritas Microplate Luminometer by Turner Biosystems. In an aspect, a fluorometer may be used to detect the conjugate. Multiple detection techniques can also be used in sequence or in parallel. For example, the conjugate may be detected by chemiluminescence and fluorescence. In another aspect, the conjugate can be detected by chemiluminescence.

Detectors using different detection techniques for the conjugate may be reversible or irreversibly attached, for example in a modular fashion, to a machine that is capable of performing the method for determining the presence of a target nucleic acid molecule in a sample.

As described herein, detection of the label on the second antibody is indicative of the presence of one or more of the target nucleic acid molecules in the sample that are complementary to the one or more probes. Following washing, the sample is suspended in a detection buffer that for example, contains the substrate for the label on the second antibody.

In one aspect, the sample is comprised of cervical cells. The method for determining the presence of a target nucleic acid molecule in a sample of cervical cells comprises suspending the sample in a detergent-based collection medium and mixing by hand mixing. In another aspect the mixing is mechanical. An approximately 50 µl aliquot of the sample is removed and mixed with about 25 µl of a denaturation reagent. The sample is mixed by hand mixing or mechanical shaking at between about 600 to about 1200 rpm for about 30 to about 60 seconds and heated at about 70° C. for about 30 minutes. High risk HPV RNA probes are prepared in a diluent and diluted to about 375 ng/ml. About 40 µl of diluted probe is added to the sample on a 70° C. heating block. The samples are further incubated at approximately 68.5° C. with shaking at about 1150 rpm for about 30 minutes. The supernatant can be removed by a dropper bottle or other low tech device. About 35 µl of the detection reagent is added to the sample. The detection reagent contains a second antibody that is labeled. The second antibody is specific for double-stranded nucleic acid hybrids. The sample containing the detection reagent is incubated at about 45° C. for about 30 minutes, placed on a magnetic rack for about 30 seconds to 3 minutes and the supernatant is decanted. In another aspect the sample containing the detection reagent is incubated at room temperature. The sample is then washed with wash buffer about four or five times.

Anti-hybrid Antibodies

The double-stranded nucleic acid hybrids formed in accordance with the present invention can be captured and detected using antibodies that are specific to double-stranded nucleic acid hybrids. The antibody is specific to double-stranded hybrids, such as but not limited to RNA-DNA; DNA-DNA; RNA-RNA; and mimics thereof, where mimics refer to molecules that behave similarly to RNA-DNA, DNA-DNA, or RNA-RNA hybrids. The anti-double-stranded nucleic acid hybrid antibody, i.e., the anti-hybrid antibody that is utilized will depend on the type of double-stranded nucleic acid hybrid formed. In one aspect, the anti-hybrid antibody is immunospecific to RNA-DNA hybrids.

It will be understood by those skilled in the art that either polyclonal or monoclonal anti-hybrid antibodies can be used and/or coupled to beads and/or immobilized on a support in the present assay as described below. Monoclonal antibody prepared using standard techniques can be used in place of the polyclonal antibodies. Monoclonal antibodies may be produced by methods that are standard in the art. In an aspect, the antibodies used for capture and detection of the target nucleic acid are monoclonal antibodies. In an aspect, monoclonal antibodies support high stringency incubation temperatures during the capture step. Without being limited, the high stringency incubation temperatures during the capture step may be between about 65° to about 75° C. or between about 68° to about 75° C. The first and second antibodies may be the same for capture and detection (i.e., produced by the same hybrid myeloma cell line) or may be different and produced by different hybrid myeloma cell lines. In one aspect, the first and second monoclonal antibodies used for capture and/or detection are the same and are specific for RNA-DNA hybrids. Also included are immunofragments or derivatives of antibodies specific for double-stranded hybrids, where such fragments or derivatives contain binding regions of the antibody.

For example, a monoclonal anti-RNA-DNA hybrid antibody derived from myeloma cells fused to spleen cells that are immunized with an RNA-DNA hybrid can be used. The hybrid-specific antibody can be purified by affinity purification against RNA-DNA hybrids immobilized on a solid support, for example as described in Kitawaga et al., Mol. Immunology, 19:413 (1982); and U.S. Pat. No. 4,732, 847, the contents of each of which are incorporated herein by reference in their entirety.

Other suitable methods of producing or isolating antibodies, including human or artificial antibodies, can be used, including, for example, methods that select recombinant antibody (e.g., single chain $F_v$ or $F_{ab}$, or other fragments thereof) from a library, or which rely upon immunization of transgenic animals (e.g., mice) capable of producing a repertoire of human antibodies (see, e.g., Jakobovits et al., Proc. Natl. Acad. Sci. USA, 90:2551 (1993); Jakobovits et al., Nature, 362: 255 (1993); and U.S. Pat. Nos. 5,545,806 and 5,545,807, the contents of each of which are incorporated herein by reference in their entirety).

In one aspect, the target nucleic acid to be detected is DNA (e.g., HPV genomic DNA or cDNA) or RNA (e.g., mRNA, ribosomal RNA, nuclear RNA, transfer RNA, viral RNA, heterogeneous nuclear RNA), wherein the one or more polynucleotide probes are polyribonucleotides or polydeoxyribonucleotides, respectively. In a preferred aspect, the double-stranded nucleic acid hybrids are DNA-RNA hybrids formed by hybridization of target DNA and probe RNA, and can be detected using an antibody that is immunospecific to RNA-DNA hybrids.

In an aspect of the present invention, a monoclonal anti-RNA-DNA hybrid antibody derived from a hybridoma cell line is used. Such hybridoma cell lines are described in U.S. Pat. Nos. 4,865,980, 4,732,847, and 4,743,535, the contents of each of which are incorporated herein by reference in their entirety. Hybrid-specific monoclonal antibodies may be prepared using techniques that are standard in the art. The hybrid-specific monoclonal antibody may be used for both capturing and detecting the target nucleic acid.

While any vertebrate may be used for the preparation of polyclonal anti-RNA-DNA hybrid antibodies, goats or rabbits are preferred. Preferably, a goat or rabbit is immunized with a synthetic poly(A)-poly(dT) hybrid by injecting the hybrid into the animal in accordance with conventional injection procedures. Polyclonal antibodies may be collected and purified from the blood of the animal with antibodies specific for the species of the immunized animal in accordance with well-known antibody isolation techniques. For the production of monoclonal antibodies, the spleen can be removed from the animal after a sufficient amount of time, and splenocytes can be fused with the appropriate myeloma cells to produce hybridomas. Hybridomas can then be screened for the ability to secrete the anti-hybrid antibody. Selected hybridomas may then be used for injection into the peritoneal cavity of a second animal for production of ascites fluid, which may be extracted and used as an enriched source of the desired monoclonal antibodies incorporated herein by reference.

Polynucleotide Probes

The polynucleotide probes are designed to hybridize or bind with the target nucleic acid molecules. In another aspect, the polynucleotide probes are designed to bind to target nucleic acid molecules. In one aspect, the probes are capable of hybridizing or binding to HPV and HPV high risk variants. In an additional aspect, the polynucleotide probes are specific for HPV and HPV high risk variants. High risk (HR) nucleic acid probes can include probes for HPV high risk types 16, 18, 26, 31, 33, 35, 39, 45, 51, 52, 56, 58, 59, 66, 68, 73, and 82. In another aspect, High Risk nucleic acid probes can include probes for HPV high risk types 16, 18, 31, 33, 35, 39, 45, 51, 52, 56, 58, 59, 66, 68, and 82. In other aspects the RNA or DNA probes are fragments. In an aspect, the probes are about 6 to about 8 kilobases in length, about 7.5 kilobases, and may be produced using a plasmid template using a BLUESCRIPT vector. However, other plasmids, vectors and methods are known in the art and could also be used to produce the RNA probes described herein.

The probes may vary in amount from about 7.5 ng to about 60 ng per HPV type per assay, or from about 20 ng to about 45 ng per HPV type per assay, or about 30 ng of probe for each HPV type per assay is used. Thus, in one aspect the HR probes consist of or consist essentially of one or more probes for HPV high risk types 16, 18, 26, 31, 33, 35, 39, 45, 51, 52, 56, 58, 59, 66, 68, 73, and 82 or low risk HPV types 1, 2, 3, 4, 5, 6, 8, 11, 13, 30, 34, 40, 42, 43, 44, 53, 61, 67, 69, 70, 71, 72, 74, 81, 83, 84, and 89 wherein about 30 ng of each probe is used per assay for detection of the target nucleic acid molecule.

In another aspect, a combination or set of nucleic acid molecules is targeted. For example, a set of target nucleic acid molecules can include high risk HPV types 16, 18, and 45. In an aspect, the set of nucleic acid molecules to be targeted include only high risk HPV types 16, 18, and 45. Further, a set of target nucleic acid molecules can comprise, consist essentially of, or consist of polynucleotide probes hybridize with or are specific for high risk HPV types 16, 18, and 45 and may be used with any of the methods disclosed herein.

The RNA probes may be short synthetic RNA probes that specifically bind only to the target nucleic acid molecule. Examples are described in U.S. patent application Ser. No. 12/426,076, filed on Apr. 17, 2009, the contents of which are incorporated herein by reference in its entirety.

In certain aspects a probe mixture comprising multiple sets of probes is used to simultaneously screen for any one of a mixture of desired target nucleic acids. For example, it may be desirable to screen a biological sample for the presence of any HR HPV type. In such a situation, a probe set 75% or more, 80% or more, 85% or more, 90% or more, 95% or more, 98% or more, or 100% identical to SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, or SEQ ID NO: 95, SEQ ID NO: 97, SEQ ID NO: 98, SEQ ID NO: 99, SEQ ID NO: 100, SEQ ID NO: 101, SEQ ID NO: 102, or SEQ ID NO: 103, OR SEQ ID NO: 117, SEQ ID NO: 117 may be used. For example, a probe mixture can be designed to provide a probe set for every HR HPV so one test can be run to identify whether the sample had any HR HPV target nucleic acid.

Strategically Truncated Probes

In an aspect, the strategically-truncated probes are capable of hybridizing, binding to, or are specific for HPV high-risk types. In another aspect, the strategically-truncated probes are capable of hybridizing, binding to, or are specific for HPV high risk types and the deleted portion exhibits high sequence identity or cross reactivity to a HPV low risk type. In another aspect, the strategically-truncated probes are truncated at both the E1 and E2 positions of the HPV sequence where identity with LR types tends to be highest (See FIGS. 1-9). The strategically-truncated probes may also be truncated at the E1, E2, and L1 positions of the plasmid (See FIGS. 1, 4, 7-8) or truncated at the E1, E2, and L2 positions of the plasmid (See FIG. 9) in areas of the HPV genome showing high sequence identity with the low risk types.

In a further aspect, the total amount of deleted sequence in the one (X) or two (XX) deletions range from approximately 1.4 to 2.4 Kb. In another aspect, the deletion is from about 100 to about 200 base pairs, from about 150 to about 300 base pairs, from about 200 to about 500 base pairs, from about 500 to about 1000 base pairs, from about 1200 to about 1500 base pairs, or from about 1000 to about 2000 base pairs. In another aspect, a first deletion is from about 150 to about 300 base pairs or about 200 to about 500 base pairs and a second deletion is from about from about 1200 to about 1500 base pairs or from about 1000 to about 2000 base pairs. In another aspect, the deleted portion exhibits high sequence identity, cross reactivity, or hybridizes to a HPV low risk type, such as to low risk HPV types 1, 2, 3, 4, 5, 6, 8, 11, 13, 30, 34, 40, 42, 43, 44, 53, 61, 67, 69, 70, 71, 72, 74, 81, 83, 84, and 89.

In another aspect, the polynucleotide probes are strategically-truncated probes about 75% or more, 80% or more, 85% or more, 90% or more, 95% or more, 98% or more, or 100% identical to SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 116, or SEQ ID NO: 117. In one aspect, the strategically-truncated probes are fragments from about 100 to about 200 base pairs, from about 150 to about 300 base pairs, from about 200 to about 500 base pairs, from about 500 to about 1000 base pairs, from about 1200 to about 1500 base pairs, or from about 1000 to about 2000 base pairs contiguous base pairs in length of SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 116, or SEQ ID NO: 117.

In an aspect, the one or more polynucleotide probes include a probe set of one or more probes sharing at least about 75% or more, 80% or more, 85% ore more, 90% or more, 95% or more, 98% or more, or 100% identity to SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 97, SEQ ID NO: 98, SEQ ID NO: 99, SEQ ID NO: 100, SEQ ID NO: 101, SEQ ID NO: 102, or SEQ ID NO: 103, OR SEQ ID NO: 116, or SEQ ID NO: 117. The disclosure also provides for probe sets including one or more, two or more, three or more, four or more, or five or more of the probes described herein.

In an aspect, the strategically-truncated probes are capable of reducing cross reactivity, hybridization, or binding with low risk HPV types. In another aspect, one of more strategically-truncated probes of SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 97, SEQ ID NO: 98, SEQ ID NO: 99, SEQ ID NO: 100, SEQ ID NO: 101, SEQ ID NO: 102, or SEQ ID NO: 103 are capable of reducing cross reactivity with one or more low risk HPV types 1, 2, 3, 4, 5, 6, 8, 11, 13, 30, 34, 40, 42, 43, 44, 53, 61, 67, 69, 70, 71, 72, 74, 81, 83, 84, and 89.

In one aspect, the present disclosure provides an isolated polynucleotide at least about 50% or more, 75% or more, 80% or more, 85% or more, 90% or more, 95% or more, 98% or more, or 100% identical to SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 97, SEQ ID NO: 98, SEQ ID NO: 99, SEQ ID NO: 100, SEQ ID NO: 101, SEQ ID NO: 102, or SEQ ID NO: 103, OR SEQ ID NO: 117, or fragments or complements thereof.

In one aspect, the disclosure provides for an isolated polynucleotide capable of hybridizing or specifically binding to HPV 26 comprising a sequence 50% or more, 75% or more, 80% or more, 85% or more, 90% or more, 95% or more, 98% or more, or 100% identical to SEQ ID NO: 87 or SEQ ID NO: 97 (26)04 fragments, or complements thereof; an isolated polynucleotide capable of hybridizing or specifically binding to HPV 33 comprising a sequence at least 50% or more, 75% or more, 80% or more, 85% or more, 90% or more, 95% or more, 98% or more, or 100% identical to SEQ ID NO: 88 or SEQ ID NO: 98 (33X), fragments, or complements thereof an isolated polynucleotide capable of hybridizing or specifically binding to HPV 39 comprising a sequence at least 50% or more, 75% or more, 80% or more, 85% or more, 90% or more, 95% or more, 98% or more, or 100% identical to SEQ ID NO: 89 or SEQ ID NO: 99 (39XX) fragments, or complements thereof an isolated polynucleotide capable of hybridizing or specifically binding to HPV 52 comprising a sequence 50% or more, 75% or more, 80% or more, 85% or more, 90% or more, 95% or more, 98% or more, or 100% identical to SEQ ID NO: 90 or SEQ ID NO: 100 (52X), fragments, or complements thereof an isolated polynucleotide capable of hybridizing or specifically binding to HPV 56 comprising a sequence 50% or more, 75% or more, 80% or more, 85% or more, 90% or more, 95% or more, 98% or more, or 100% identical to SEQ ID NO: 91 or SEQ ID NO: 101 (56XX) fragments, or complements thereof an isolated polynucleotide capable of hybridizing or specifically binding to HPV 58 comprising a sequence 50% or more, 75% or more, 80% or more, 85% or more, 90% or more, 95% or more, 98% or more, or 100% identical to SEQ ID NO: 92 or SEQ ID NO: 102 (58X), fragments, or complements thereof an isolated polynucleotide capable of hybridizing or specifically binding to HPV 66 comprising a sequence 50% or more, 75% or more, 80% or more, 85% or more, 90% or more, 95% or more, 98% or more, or 100% identical to SEQ ID NO: 93 or SEQ ID NO: 103 (66XX) fragments, or complements thereof an isolated polynucleotide capable of hybridizing or specifically binding to HPV 68 comprising a sequence 50% or more, 75% or more, 80% or more, 85% or more, 90% or more, 95% or more, 98% or more, or 100% identical to SEQ ID NO: 94 or SEQ ID NO: 104 (68XX), fragments, or complements thereof; and an isolated polynucleotide capable of hybridizing or specifically binding to HPV 73 comprising a sequence 50% or more, 75% or more, 80% or more, 85% or more, 90% or more, 95% or more, 98% or more, or 100% identical to SEQ ID NO: 95 or SEQ ID NO: 105 (73XX), fragments, or complements thereof.

In another aspect, high risk HPV sequences exhibiting cross-reactivity or specificity to low risk HPV sequences are identified for target deletions. Cross-reactivity may be predicted by percent identity from sequence alignments using any known sequence identifying database, such as any of the bioinformatics tools described herein. In an aspect, after the high risk HPV sequences exhibiting cross-reactivity or identity to low risk HPV sequences are identified for target deletions, a portion of the sequence exhibiting cross-reactivity or identity to low risk HPV sequences is removed. A second, third, fourth, fifth or more deletion can be made if significant cross-reactivity is present after the first deletion. In another aspect, deletions are initiated using the Invitrogen GeneTailor™ Site-Directed Mutagenesis System.

Bioinformatics tools can be employed to determine the one or more polynucleotide probes. For example, Oligoarray 2.0, a software program that designs specific oligonucleotides can be utilized. Oligoarray 2.0 is described by Rouillard et al., Nucleic Acids Research, 31: 3057-3062 (2003), which is incorporated herein by reference. Oligoarray 2.0 is a program which combines the functionality of BLAST (Basic Local Alignment Search Tool) and Mfold (Genetics Computer Group, Madison, Wis.). BLAST, which implements the statistical matching theory by Karlin and Altschul (Proc. Natl. Acad. Sci. USA 87:2264 (1990); Proc. Natl. Acad. Sci. USA 90:5873 (1993), is a widely used program for rapidly detecting nucleotide sequences that match a given query sequence One of ordinary skill in the art can provide a database of sequences, which are to be checked against, for example HPV high risk and low risk types 1, 2, 3, 4, 5, 6, 8, 11, 13, 16, 26, 30, 31, 33, 34, 35, 39, 40, 42, 43, 44, 45, 51, 52, 53, 54, 56, 58, 59, 61, 62, 66, 67, 68, 69, 70, 71, 72, 73, 74, 81, 82, 83, 84, and 89. The target sequence of interest, e.g. HPV 18, can then be BLASTed against that database to search for any regions of identity. Melting temperature (Tm) and % GC can then be computed for one or more polynucleotide probes of a specified length and compared to the parameters, after which secondary structure also can be examined. Once all parameters of interest are satisfied, cross hybridization can be checked with the Mfold package, using the similarity determined by BLAST. The various programs can be adapted to determine the one or more polynucleotide probes meeting the desired specificity requirements. For example, the parameters of the program can be set to prepare polynucleotides of 25nt length, Tm range of 55-95° C., a GC range of 35-65%, and no secondary structure or cross-hybridization at 55° C. or below.

Cross-Reactivity

The present invention also provides for assay compositions, probes, and conditions wherein cross-reactivity between HPV HR probe sets and low risk HPV types is dramatically reduced when compared to the standard FDA approved HPV assay and probe set. In one aspect, the HPV HR probe set is selected from the group consisting of HPV high risk types 16, 18, 26, 31, 33, 35, 39, 45, 51, 52, 56, 58, 59, 66, 68, 73, and 82 or low risk HPV types 1, 2, 3, 4, 5, 6, 8, 11, 13, 30, 34, 40, 42, 43, 44, 53, 61, 67, 69, 70, 71, 72, 74, 81, 83, 84, and 89. Using the present assay with these HR HPV probes, cross-reactivity between low risk HPV types and high risk HPV probes is reduced. See, for example, U.S. patent application Ser. No. 12/426,076.

The present invention also provides a method for determining the presence of a target nucleic acid molecule, such as HPV, in a sample in about 2 hours or less, about 2.5 hours or less, about 3 hours or less, about 3.5 hours or less, about 4 hours or less, about 5 hours or less, about 6 hours or less, about 7 hours or less, about 8 hours or less, about 12 hours or less, about 24 hours or less, in other aspects, less than about 3.5 hours for at least 10 samples using the methods discussed above. One reason why the presence of HPV or other target nucleic acid molecules can be determined in short periods of time is because the method does not amplify the target nucleic acid molecule prior to detection. Instead of target amplification, signal amplification may be used to accurately detect the presence of HPV or other target nucleic acid molecules. In an aspect, the methods of the disclosure may include a signal amplification step. In an aspect, the methods of the disclosure do not include a target amplification step. In another aspect, the methods of the disclosure may include a signal amplification step and no target amplification step.

The present disclosure also provides methods and assays for detecting cancer, for example cervical cancer, by detecting the presence of a target nucleic acid molecule, such as HPV, in a sample in about 2 hours or less, about 2.5 hours or less, about 3 hours or less, about 3.5 hours or less, about 4 hours or less, about 5 hours or less, about 6 hours or less, about 7 hours or less, about 8 hours or less, about 12 hours or less, about 24 hours or less, in other aspects, less than about 3.5 hours for at least 10 samples using the methods and assays as discussed above.

It will be understood to those skilled in the art that the present invention can be carried out on a number of platforms including, but not limited to, tubes, dipsticks, microarrays, microplates, 384 well plates, other microtiter plates and microfluidic systems. It will be understood to those skilled in the art that the present, can be automated.

Another aspect of the present invention provides a collection medium into which samples containing the target nucleic acid are collected. The collection medium provides sample stability for several days, several weeks, or several months. For example, the collection medium may provide sample stability for at least 1 week, at least 2 weeks, at least 3 weeks, at least 4 weeks, at least 1 month, at least 2 months, at least 3 months, at least 4 months, at least 5 months, at least 6 months, from about 1 week to about 4 weeks, from about 1 month to about 3 months, from about 3 to about 4 months, or from about 3 month to 6 months. In another aspect, the collection medium provides sample stability for at least 21 days at 33° C. or at least 6 months at 20° C. In an aspect the above sample is a cervical cell sample or a human cervical cell sample. Suitable collection media are described herein. In one aspect, the collection medium comprises, consists of, or consists essentially of NP-40, deoxycholate, Tris-HCl, EDTA, NaCl, and sodium azide. In other aspects, the collection medium comprises, consists of, or consists essentially of 1.0% NP-40, 0.25% sodium deoxycholate, 50 mM Tris-HCl, 25 mM EDTA, 150 mM NaCl, and 0.09% sodium azide.

Another aspect is a detergent-containing wash buffer comprising, consisting of, or consisting essentially of 40 mM Tris pH 8.2, 100 mM NaCl, 0.1% to 0.5% Triton X-100, and 0.09% sodium azide. Yet another aspect is a detergent-free wash buffer comprising, consisting of, or consisting essentially of 40 mM Tris pH 8.2, 100 mM NaCl, and 0.09% sodium azide.

High Throughput Assay

An aspect relates to a high throughput assay and apparatus capable of being practiced with any of the methods or compositions described herein. The high throughput assay is capable of accurately and rapidly processing samples a large number of samples in a short period of time.

In an aspect, the high throughput assay is capable of processing at least 300 samples in less than 3 hours, 900 samples in about 5 hours, at least 1000 samples in about 6 hours, or at least 1500 samples in about 8 hours. In another aspect, the high throughput assay is capable of processing at least 10 microtiter plates (96 well plates, for example) in about 5 hours, at least 15 microtiter plates (96 well plates, for example) in about 7 hours, or at least 20 microtiter plates (96 well plates, for example) in about 8 hours. In an aspect, the processing of samples takes place from the start of the method or assay to the completion.

Kit

Also provided is a kit for the detection of a target nucleic acid molecule in a sample, the kit comprising, consisting of or, or consisting essentially of:
  a) a collection medium;
  b) a denaturation reagent;
  c) a polynucleotide probe;
  d) a bead coated with a first anti-hybrid antibody;
  e) a detection reagent comprising a second anti-poly hybrid antibody, wherein the second antibody is detectably labeled;
  f) a wash buffer; and
  g) a second detection reagent comprising a substrate for the label on the second antibody.

The collection medium, denaturation reagent, bead, first and second antibodies, polynucleotide probes, detection reagents, and wash buffers have been previously described.

In an aspect, the kit included one or more HPV high risk probes and the deleted portion shares high sequence identity or cross reactivity to a HPV low risk type. In an aspect, the HPV high risk probe is specific for or capable of hybridizing to one or more of HPV types 16, 18, 26, 31, 33, 35, 39, 45, 51, 52, 56, 58, 59, 66, 68, 73, and 82 and the deleted portion shares cross reactivity or specificity with one or more of low risk HPV types 1, 2, 3, 4, 5, 6, 8, 11, 13, 30, 34, 40, 42, 43, 44, 53, 61, 67, 69, 70, 71, 72, 74, 81, 83, 84, and 89. In another aspect, the polynucleotide probes are nucleic acid sequences sharing 75% or more, 80% or more, 85% or more, 90% or more, 95% or more, 98% or more, or 100% identity to SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 97, SEQ ID NO: 98, SEQ ID NO: 99, SEQ ID NO: 100, SEQ ID NO: 101, SEQ ID NO: 102, SEQ ID NO: 103, or SEQ ID NO: 117.

Apparatus

An aspect relates to a high throughput apparatus capable of being practiced with any of the methods or compositions described herein. In an aspect, the compositions, methods, assays, and kits described herein are used together with the apparatus described in U.S. patent application Ser. Nos. 12/508,304, 12/508,306, 12/622,131, 12/605,540, and 12/605,605, each of which are incorporated by reference in their entirety. The instruments described in U.S. patent application Ser. Nos. 12/508,304, 12/508,306, 12/622,131, 12/605,540, and 12/605,605 have broad-based applications and are capable of accurately and rapidly processing samples a large number of samples in a short period of time. Without being limited, the systems and instruments described in described in U.S. patent application Ser. Nos. 12/508,304, 12/508,306, 12/622,131, 12/605,540, and 12/605,605, can be used to detect and analyze nucleic acid molecules associated with nucleic acid molecules associated with any one of cervical samples (e.g., a sample obtained from a cervical swab) or cervical cell samples, adenoid cells, anal epithelial cells, blood, saliva, cerebral spinal fluid, pleural fluid, milk, lymph, sputum, urine and semen, other viral, bacteria, mycobacteria or plasmodia, for example cytomegalovirus (CMV), herpes, HIV, H1N1, chlamydia, gonorrhea, *Neisseria gonorrhoeae* (GC), *Chlamydia trachomatis* (CT), *Trichomonas vaginalis*, *Staphylococcus aureus*, tuberculosis, SARS-associated coronavirus or influenza. Moreover, the systems and instruments described in described in U.S. patent application Ser. Nos. 12/508,304, 12/508,306, 12/622,131, 12/605,540, and 12/605,605 can be used to detect and analyze nucleic acid molecules associated with HPV, genetic variants of HPV, HPV DNA of a high risk HPV type, HPV RNA of a high risk HPV type, or any one of high risk HPV types 16, 18, 26, 31, 33, 35, 39, 45, 51, 52, 56, 58, 59, 66, 68, and 82 or any one of low risk HPV types 1, 2, 3, 4, 5, 6, 8, 11, 13, 30, 34, 40, 42, 43, 44, 53, 61, 67, 69, 70, 71, 72, 74, 81, 83, 84, and 89.

EXAMPLES

Example 1

In order to generate probes specific for HR-HPV having a minimal risk of cross-reacting with LR-HPV, deletion plasmids of each HR-HPV genome were generated. These strategically-truncated plasmids include the full length sequence for each HR-HPV, minus certain regions having a relatively high degree of homology with LR-HPV nucleic acids.

1. Selection of Targets for Deletion

Sequence alignments are performed comparing 15 HR-HPV types (HPV 16, 18, 31, 33, 35, 39, 45, 51, 52, 56, 58, 58, 59, 66, 68, and 82) with 28 LR-HPV types (HPV 1, 2, 3, 4, 5, 6, 8, 11, 13, 30, 34, 40, 42, 43, 44, 53, 54, 61, 67, 69, 70, 71, 72, 74, 81, 83, 84, and 89) to determine overall sequence similarities. The HR-HPV and LR-HPV sequences used are set forth in Table 1 below:

TABLE 1

|  | GenBank Accession | SEQ ID NO |
|---|---|---|
| High Risk HPV |  |  |
| HPV 16 | K02718 | 1 |
| HPV 18 | AY262282 | 2 |
| HPV 26 | X74472 | 3 |
| HPV 31 | J04353 | 4 |
| HPV 33 | M12732 | 5 |
| HPV 35 | M74117 | 6 |
| HPV 39 | M62849 | 7 |
| HPV 45 | X74479 | 8 |
| HPV 51 | M62877 | 9 |
| HPV 52 | X74481 | 10 |
| HPV 56 | X74483 | 11 |
| HPV 58 | D90400 | 12 |
| HPV 59 | X77858 | 13 |
| HPV 66 | U31794 | 14 |
| HPV 68 | DQ080079 | 15 |
| HPV 73 | X94165 | 16 |
| HPV 82 | AB027021 | 17 |
| Low Risk HPV |  |  |
| HPV 1 | NC_001356 | 18 |
| HPV 2 | NC_001352 | 19 |
| HPV 3 | X74462 | 20 |
| HPV 4 | NC_001457 | 21 |
| HPV 5 | NC_001531 | 22 |
| HPV 6 | AF092932 | 23 |
| HPV 8 | PPH8CG | 24 |
| HPV 11 | M14119 | 25 |
| HPV 13 | X62843 | 26 |

TABLE 1-continued

|  | GenBank Accession | SEQ ID NO |
|---|---|---|
| HPV 30 | X74474 | 27 |
| HPV 34 | NC_001587 | 28 |
| HPV 40 | X74478 | 29 |
| HPV 42 | M73236 | 30 |
| HPV 43 | AJ620205 | 31 |
| HPV 44 | U31788 | 32 |
| HPV 53 | NC_001593 | 33 |
| HPV 54 | HPU37488 | 34 |
| HPV 55 | HPU31791 | 35 |
| HPV 61 | HPU31793 | 36 |
| HPV 62 | AY395706 | 37 |
| HPV 64 | N/A | 38 |
| HPV 67 | D21208 | 39 |
| HPV 69 | AB027020 | 40 |
| HPV 70 | HPU21941 | 41 |
| HPV 71 | AB040456 | 42 |
| HPV 72 | X94164 | 43 |

Results of this sequence alignment are shown at FIG. 30. HR sequences showing the highest percentage of identity with LR types are identified for targeted deletions. Based on this, HPV 26, 33, 39, 52, 56, 58, 66, 68, and 73 are selected as candidate plasmids for sequence removal to reduce LR cross-reactivity.

2. Site-Directed Mutagenesis

Based on the HR/LR sequence alignment results, the most homologous region in each HR-HPVs initially are deleted. Bluescript plasmids comprising the full-length HR-HPV sequence of interest are methylated at 37° C. for one hour. The plasmid is then amplified using overlapping amplification primers. One of the amplification primers overlaps with the region of the target selected for deletion, while the other does not. The resulting amplification products thus are unmethylated linear amplicons that correspond to the target sequence, minus the sequence selected for deletion. The target sequence and the amplicons are then transfected into an *E. coli* strain, which digests the methylated target and circularizes and amplifies the unmethylated linear amplicons. Exemplary workflows for this method are demonstrated at FIGS. 22-29.

The sequence of the sites that have been targeted for deletion are set forth below at Table 2:

TABLE 2

| SEQ ID NO | HPV Type [Length] | Sequence |
|---|---|---|
| 44 | HPV26 [490 bp] | CCGTTGTATGCCGGCCTGTAACATAAACTTACGCCCTAGTGGAAATTGA<br>TCCAAATCAATAGAAAATTTTTCTTTTAAATCTACATCCCAAAATTTAAAT<br>TTTTGAAAAGGATCTTCCTTTGGCACAGGAGGGGCGTTACGCTGACAGGT<br>AGTAGCAGAGTTTTTAATAAACCTATAGGCATCTTCCAAACTAGCAGTGG<br>GAGGTAAGGTTAGTCCAAAATTCCAATCCTCCAATATGGAGGCATTCATT<br>AAATGTATGTAAGCCATAACATCTGTTGTAAGTGTTATTTTACACAACTGA<br>AATATAAATTGTAATTCATATTCTTCGCCATGTCTTATAAATTGTTTATAAT<br>CAGATGGTTTAAATGGAGTGGATGCAGATGCTGCAGATAATGTACTAATG<br>GTAAGGTTAGTACTGCGGGTGGTATCAACACAGGTAACAAACAATTGATT<br>GCCCCAACAGATACCATTATTATGACCCTGTGCACGT |
| 111 | HPV26 [1514 bp] | TTTTGTTTACACACAACAGTAGAGGGCACCACCTGGTGGTTTATACATTGC<br>ATGTTTCCTTCACGAGCTTTATAAAATATTGCACATTCATATCGTACCAGT<br>TTCCAATAATCAATTTGATCAGTTAATTTATTACTGTCCAGTTCATAATAGT<br>CTAGTATTTTCTCCTGGCACGCATTTAAACGCTGGCAAAGGTTCTCCATTT<br>TCTTTGTCCGCGTCCTCCTCCAAATCTAATCTGGACCAGGTGGTGGAAAAA<br>AAGCTTTTCCAATTTACATCAGTCAATGCATATACAGGATTCCCATTGCTG<br>TCAAATGGAAATGTATTTGGAAATGGTATCACTGTTACTCTACTATGTAAA<br>TACAAAAGTGAGTTATCTTCTTGAGGATTTATATTTGAGGTAATTATTAAT<br>GGGGGGCATGTAACTTGCAGTAGGCTTCTATGTTTTCTGTCTATACAACAG<br>GGATTTCCATCTAAAAAGTTACGTAAATATTTATCAATATATAACCAGCAG<br>CTATATGTAGCATCATCTAATACTGCAACTTTTGCATCTTCTAAAGGCTGC<br>AGCCAAAAATGGCTATTTGAATTTACATATGAAATGACTGACCCTTGCATA |

TABLE 2-continued

| SEQ ID NO | HPV Type [Length] | Sequence |
|---|---|---|
| | | AATTTTATAAAACTCATTGCAAACTGTGACTTACCAGTATTTGGCGGTCCA<br>TATATTACTATACAATTGTGCTTTGGGGTACCCTTTAAAAACTGTTTTAAC<br>ACTTGTAAAAAATAAATAAAGTTTACATGTTGAAACCTTAAAAATTTGGC<br>AATTTCCTTCCACGACCCGCCCTCTTCTATTTTAGAACATCTATATTGTAGC<br>CATTGTGACATACACATAGATCGTTTCTGTGCTCTTTTATAATGTCTAGTCA<br>TGGTTGCACAGTCTTTTACATATTTTGCCTGACAATTGCTTTTTAAAAAGG<br>CAGCTGCATTACTATCTATGTCAGCTAACTGTGCATATTTAAATGCAATTT<br>CACTATCATCTGTTATGTCATGATCGAACGCCCATTGCACCATTTTTGATA<br>AATCAAATGTAGCATCATCAAAACTATGTTCTAATTGTGTTTGTCGTACTA<br>TCCATTCTGGTGTATCTCCATATGTCTCACTTATATTGGACAACCCTGTTTT<br>ATAAAAATATAATGCTACTGCTGTACTTCGCAATTTTGGTGGTTCAATTAG<br>TAATTGCGTTTCTGGCACATTTAATAACATACATAGGCAGTTTTTAATTGT<br>TGTTCTGTTTTTTGCACATGTAAAGCGCACTAGCATTAGTACTATTACTCCC<br>CAATTACATGTTAAACATTGTATATGATAATATAAACAATATTGTTGTATT<br>AATGATTTAATACTTTCTGCTACAGAGCCTGCCACACCGAATGCTGCACAC<br>ACCCAATCTGAACAGCATGTTTTGTCACTTTTAAACACCCGTACTAGTTCT<br>GCAAAACTTACACCATATACTGTTTTAAATTTACTTAACAATGCTGCTTTT<br>ACATTACTACATTTTAATAATTCACATATTT |
| 45 | HPV33<br>[1460 bp] | GTCTCTAATGCCATTTGTAGTTCAATTACTTGAAATGCTTTGGTCTTTGA<br>TGCTAACAAAGAAGGCACCACCTGGTGGCATAAATGTGAAAATCCCATTT<br>GTTTGGCTGTATACAATAAAGCACACTCCATGCGTATCAGTTTCCAATGTT<br>CAATTTGTGATGGTAAATCAGTTTTATCAGCTTCGTAAAGAGCTAGCATTT<br>TCTCCTGCACTGCATTTAAACGTGCTGATATTTCCTCCATGGTTTTCCTTGT<br>CCTCTTCCTCTATTAAATCTAATTTGCACCACGTCCTTGAGAAAAAGGATT<br>TCCAATTTTCATCATTTATTGCATACACTGGGTTACCATTTTCATCAAATGG<br>GAATGGATTTTTAAATTCAAATACTGTTAATCTACTATGTAAATATGGCCA<br>TCTAGAGTCTGTGCCTGCATTTGTATTTGAGGTAAGAAGCAGTGGTGGACA<br>TTTTAATTGCACTAATGCCCTATGTTTCACATCTATTGAAATTTCATTTCCA<br>TCTAACGCATTTCTCATGTAATCATCTATATATGTCCAACTTATTGGCGTTA<br>CATCATCTATCATTCCTATTTTTGCATCTGATAATGGCTGCAACCAAAAGT<br>GACTTTTAGAATTTACACATGATATAACACACCCTTTTAAAAACTGTATTA<br>AACTCATTCCAAAATATGACTTTCCTGTATTTGCTGGTCCACAAATTAGCA<br>TACAGCTTTTTTTGGTATACCTTTTAAAAACTTTTTAAATGCACCTAAAAA<br>TGCTGTAAATTCAATGTTTTGATATCTTAACAACTGTACTATTGGTCTCCA<br>ATTTCCTCCATCATTTGTTTTTTCACATCTACTTTGTATCCATTGTCCTATTG<br>ACATTTTACGTTTTTCTGCTTTTTTATAATGTCTACACATTATTCCACAGTC<br>CTTTACTATTTTTGCTTGTGAGTTACTTTTTAAAAATGCAGCAGCATTACTA<br>TTTGAATCTGCAAGTTGTGCATAATAATATGCAATGTCACTATCGTCCGTT<br>AACTCGTTATCATATGCCCACTGTACCATTTCACTTAAATCAAATATATTA<br>TCATTAAAGCTATGTTGTAAAACAGTTAGTCTATCTATCCATTCAGGTGTT<br>GTACCTTGTACATCACTAATGTTTGACATTGCTGTTCTAAACCAATACAAT<br>GCACATGTTTGGCTCCGTAATTTTGGTGGCTCTATAACCATACATGTTTCA<br>GGTATTGATAATAAATTACTCATTAGTTTTGCTACTGTTAACCTGTTTTTGC<br>TACACCTAAATCTAATTAACAATAATATTATTATTCCTCTATCGCAAGTTA<br>AACATTGTAAATGAGTATACAAACTATGCTGTTTAATTAATACTTTTAAAC<br>TTTCTGCTACTGATGGACTAATTCCATATCCTGTTATACACCAATCTGTAC<br>AGCTTGTTTTATCACTTTTAAATG |
| 46 | HPV33<br>[1459 bp] | GTCTCTAATGCCATTTGTAGTTCAATTACTTGAAATGCTTTGGTCTTTGA<br>TGCTAACAAAGAAGGCACCACCTGGTGGCATAAATGTGAAAATCCCATTT<br>GTTTGGCTGTATAAAATATTTCCCTCCATAATGGATCCGTTTCCAATGTTC<br>AATTTGTGATGGTAAATCAGTTTTATCAGCTTCGTAAAGATCTAGTATTTT<br>CTCCTGCACTGCATTTAAACGTGCTGATATTTCCTCCATCGTTTTCCTTGTC<br>CTCTTCCTCTATTAAATCTAATTTGCACCACGTCCTTGAGAAAAAGGATTT<br>CCAATTTTCATCATTTATTGCATACACTGGGTTACCATTTTCATCAAATGG<br>GAATGGATTTTTAAATTCAAATACTGTTAATCTACTATGTAAATATGGCCA<br>TCTAGGGTCTGTGCCTGCATTTGTATTTGAGGTAAGAAGCAGTGGTGGACA<br>TTTTAATTGCACTAATGCCCTATGTTTCACATCTATTGAAATTTCATTTCCA<br>TCTAACGCATTTCTCATGTAATCATCTATATATGTCCAACTTATTGGCGTTA<br>CATCATCTATCATTCCTATTTTTGCATCTGATAATGGCTGCAACCAAAAGT<br>GACTTTTCGAATTTACACATGATATAACACACCCTTTTAAAAACTGTATTA<br>AACTCATTCCAAAATATGACTTTCCTGTATTTGCTGGTCCACAAATTAGCA<br>TACAGCTTTTTTTGGTATACCTTTTAAAAACTTTTTAAATGCACCTAAAAA<br>TGCTGTAAATTCAATGTTTTGATATCTTAACAACTGTACTATTGGTCTCCA<br>ATTTCCTCCATCATTTGTTTTTTCACATCTACTTTGTATCCATTGTCCTATTG<br>ACATTTTACGTTTTTCTGCTTTTTTATAATGTCTACACATTATTCCACAGTC<br>CTTTACTATTTTTGCTTGTGAGTTACTTTTTAAAAATGCAGCAGCATTACTA<br>TTTGAATCTGCAAGTTGTGCATAATAATATGCAATGTCACTGTCGTCCGTT<br>AACTCGTTATCGTATGCCCACTGTACCATTTCACTTAAATCAAATATATTA<br>TCATTAAAGCTATGTTGTAAAACAGTTAGTCTATCTATCCATTCAGGTGTT<br>GTACCTTGTACATCACTAATGTTTGACATTGCTGTTCTAAACCAATACAAT<br>GCACATGTTTGGCTCCGTAACTTTGGTGGCTCTATAACCATACATGTTTCA<br>GGTATTGATAATAAATTACTCATTAGTTTTGCTACTGTTAACCTGTTTTTGC<br>TACACCTAAATCTAATTAACAATAATATTATTATTCCTCTATCGCAAGTTA<br>AACATTGTAAATGAGTATACAAACTATGCTGTTTAATTAATACTTTTAAAC |

TABLE 2-continued

| SEQ ID NO | HPV Type [Length] | Sequence |
|---|---|---|
| | | TTTCTGCTACTGATGGACTAATTCCATATCCTGTTATACACCAATCTGTAC<br>AGCTTGTTTTATCACTTTTAAATG |
| 112 | HPV33<br>[1460 bp] | ACAGTTATGTATATAATACATACCTATATAATCTACTTTCCCTGTAACCAT<br>AGTACATGTATCTTCCTCTATAATATATATTTCACCCCAGTTTGTATAATCC<br>ATTGTATTTTTTTGTCATTGTCATATTGCACAGTTACTGTTTCTCCTTGTTT<br>TTTAAAACATTTTGGTGGTTCACAAAGCCACACCTCTAAGCTTGTTGTTG<br>CAATGTCCATTGGCTTGTACTATACTGTGATTTACTTAATGTCTCTAATGCC<br>ATTTGTAGTTCAATTACTTGAAATGCTTTGGTCTTTGATGCTAACAAAGAA<br>GGCACCACCTGGTGGCATAAATGTGAAAATCCCATTTGTTTGGCTGTATAC<br>AATAAAGCACACTCCATGCGTATCAGTTTCCAATGTTCAATTTGTGATGGT<br>AAATCAGTTTTATCAGCTTCGTAAAGAGCTAGCATTTTCTCCTGCACTGCA<br>TTTAAACGTGCTGATATTTCCTCCATGGTTTTCCTTGTCCTCTTCCTCTATT<br>AAATCTAATTTGCACCACGTCCTTGAGAAAAAGGATTTCCAATTTTCATCA<br>TTTATTGCATACACTGGGTTACCATTTTCATCAAATGGGAATGGATTTTTA<br>AATTCAAATACTGTTAATCTACTATGTAAATATGGCCATCTAGAGTCTGTG<br>CCTGCATTTGTATTTGAGGTAAGAAGCAGTGGTGGACATTTTAATTGCACT<br>AATGCCCTATGTTTCACATCTATTGAAATTTCATTTCCATCTAACGCATTTC<br>TCATGTAATCATCTATATATGTCCAACTTATTGGCGTTACATCATCTATCAT<br>TCCTATTTTTGCATCTGATAATGGCTGCAACCAAAAGTGACTTTTAGAATT<br>TACACATGATATAACACACCCTTTTAAAAACTGTATTAAACTCATTCCAAA<br>ATATGACTTTCCTGTATTTGCTGGTCCACAAATTAGCATACAGCTTTTTTTT<br>GGTATACCTTTTAAAAACTTTTTAAATGCACCTAAAAATGCTGTAAATTCA<br>ATGTTTTGATATCTTAACAACTGTACTATTGGTCTCCAATTTCCTCCATCAT<br>TTGTTTTTTCACATCTACTTTGTATCCATTGTCCTATTGACATTTTACGTTTT<br>TCTGCTTTTTTATAATGTCTACACATTATTCCACAGTCCTTTACTATTTTTG<br>CTTGTGAGTTACTTTTTAAAAATGCAGCAGCATTACTATTTGAATCTGCAA<br>GTTGTGCATAATAATATGCAATGTCACTATCGTCCGTTAACTCGTTATCAT<br>ATGCCCACTGTACCATTTCACTTAAATCAAATATATTATCATTAAAGCTAT<br>GTTGTAAAACAGTTAGTCTATCTATCCATTCAGGTGTTGTACCTTGTACAT<br>CACTAATGTTTGACATTGCTGTTCTAAACCAATACAATGCACATGTTTGGC<br>TCCGTAATTTTGGTGGCTCT |
| 47 | HPV39<br>[1692 bp] | CAGTAGTGGGTACCGATCCGTCACTGGTACTGCACATAGAGTCAGGAC<br>AATGAATTATGTTGCCATTATAATGCACTTCCCATTTGCCACTAGTCCCAT<br>ACCTTTCCGCATCTTGAATAAACACTTCATAGTATACTTTTAGGTGCTCGTT<br>CATATAATATATACCCCAATAGTCCACACACCCTTCTGTTTTACACCATAT<br>GTCTATATTATTTTTATAATATATAGCACCCCATAATACATAGTTCATAGC<br>ATTACATTTGTCCCCATCATACCACACCTCCACTGTAGTTCCTTGTTTTTA<br>AAACATTGTTTTGGCTGTGTATGCCACAGTTCATTACTAGTGTCTTTTAATG<br>TCCACTCCTCTGTATTGTATTCAGTTTGTGCAACACTTTCTAGTGCCATCTG<br>CAGTTCAATAGCTTGATATGCTTTACATTTTGAAATGTTTATGGTTGGCAC<br>CACCTGGTGGTCAATAGTATGCATGCCACGTTCTCGTGCTGCATAAAATAT<br>TGCATTTTCCATTCGCACACATTTCCAATAATTAATTTGATCATATATTGAT<br>TTACTGTCTTGTTCATAGTATTCTAGTATTTTGTCCTGTAACACATTTAAAC<br>GTTGTGAAAGTGTTTTCATCATTGTCTCCTTCATCCTCGTCCTGCTGCAAGT<br>CTAATCTGCACCAAGTCTTTTCAAAAAAACATTTCCAGTTTTTATCATTGA<br>TTGTGTACACTGGATTCCTGTTTTGGTCAAATGGAAATGCATTAGGAAATT<br>TAAACACTGTTAGCCTACTACGTAAATATGGCCACCTATCGTCTTCCACAG<br>GATTGGTATTGGAGGTTATTAATAATGGTGGACATTTCATTTGTAGTAAAC<br>TTTTATATTTCCTATCTAAACTTATTGCATACCCATCTAATGCATTTCTCAT<br>ATAATTATCGAAATATGACCAGCAGGTACCGGTTGCATCATCTAACATTGC<br>TAGTTTTGCATCTGCAAGTGGTTCTAGCCAAAAGTGGCTGGTGGAGTTTAC<br>ATATGAAATAACTGTGCCCTGTAAAAAATGCATAAGGCTCATACAAAAAT<br>GTGACTTTCCTGTATTCGCAGGTCCATATATAACTATACAGTTTTTTTTGGG<br>AGTACCCTTTAAAAATTCCTTTAATGCACATAAAAAGGATATAAATTCTAT<br>TCCTTGATATCTTAAGAATTGTACTATGGGTCTCCAGTCCCGCCTTCATC<br>ACATTTACTACACCTAAATTTTATCCATTGAGACATGGACATTTGCCTTTTT<br>TGTGCTCGCTTGTAATGTTTACACATTGTTGCACAATCTTTTACATATTTTG<br>CCTGGCAGTTACTTTTTAAAAAGGCTGCAGCATTACTGTTACAATCTGCTA<br>ACATTGCATAATTAAATGCTATGTCACTTTCATCAGTATATTCATTGTCAA<br>ATGCCCATTGTACCATGTCCGATAGGTCAAATACACTATCATCTATTCCAT<br>GTTGTATAACAGTTAATCGTTGTATCCATTCGGCGTATCCCCTGTTACCA<br>CACTAATATTGGATATACCTGTGCGATACCAATATAGTGCTGCTACAGGGC<br>TGCGCAGTTTAGGAGGCTCCAGAAGCATACAACTTTCTGGAACATGTAAC<br>AATGTACTTAATCCCTTTCCTACAGTAACCCTATTTTTTCCACATGTATATC<br>TT |
| 48 | HPV 39<br>[190 bp] | ATACCACCACGATTCCAAAAATGTCTTGCAAACAGTTGTTCCCTACGTA<br>AACAGAAGAACATACTGTCCCCATACACATCTGCAGACATTTGCAAATAA<br>TCAGGATATTTACAAATGGATTGACAAATATCTAAAGGCACCTCACTTTTG<br>GTTTCCTGCAATGCACCAAAGTCCATAGCTCCATAGCCAG |
| 49 | HPV52<br>[1376 bp] | TAATAGAACCACCAAAATTACGAAGTGCTACCTGTGCATTATATTGGTA<br>TAGAACAGGTTTGTCTAATATTAGTGAGGTATATGGTACCACCCCAGAAT<br>GGATAGAACAACAAACAGTATTACAGCATAGCTTTGACAATAGCATATTC |

TABLE 2-continued

| SEQ ID NO | HPV Type [Length] | Sequence |
|---|---|---|
| | | GATTTTGGAGAAATGGTGCAATGGGCATATGATCATGATATAACAGATGA
TAGTGACATAGCATATAAATATGCACAGTTAGCAGATGTAAATAGCAATG
CTGCAGCATTCCTAAAAAGCAATTCGCAAGCAAAAATAGTAAAGGACTGT
GCAACCATGTGTAGACATTATAAACGGGCAGAAAGAAAACATATGAATAT
TGGACAATGGATACAGTATAGATGTGATAGAATAGATGATGGTGGAGATT
GGAGGCCTATAGTAAGATTTTTAAGATATCAAGACATAGAATTTACAGCC
TTTTTAGACGCATTTAAAAAATTTTTAAAAGGTATACCTAAAAAAAATTGT
TTAGTATTATATGGACCTGCAAACACAGGAAAATCATATTTTGGAATGAG
TTTAATTAGGTTCTTAAGTGGATGTGTAATATCCTATGTAAACTCAAAAAG
CCATTTTTGGCTACAACCATTAACAGATGCAAAGTGGGTATGATAGATG
ATGTAACACCTATATGTTGGACATATATAGATGATTATATGAGAAATGCA
CTGGATGGAAATGATATATCAGTAGATGTAAAGCATAGAGCCTTAGTACA
AATAAAAATGCCCACCATTAATTTTAACAACAAATACAAATGCAGGAACAG
ATCCTAGGTGGCCATATTTACATAGTAGATTGGTTGTGTTTCATTTCAAAA
ACCCATTTCCATTTGATGAAAATGGCAATCCTATATATGAAATTAACAACG
AAAATTGGAAATCCTTTTTCTCAAGGACGTGGTGCAAATTAGATTTAATAC
AGGAAGAGGACAAGGAAAACGATGGAGTCGATACCGGCACGTTTAAATG
CAGTGCAGGAAAAAATACTAGATCTATACGAAGCTGATAGTAATGACCTA
AACGCACAAATTGAACATTGGAAATTGACTCGAATGGAATGTGTTTTGTTT
TACAAAGCAAAGGAACTGGGAATAACTCATATAGGCCACCAGGTGGTGCC
ACCAATGGCAGTGTCTAAGGCAAAGGCCTGCCAAGCTATTGAACTACAAT
TGGCATTGGAGGCATTAAACAAAACACAATATAGCACAGATGGATGGACA
TTACAACAAACAAGTCTAGAAATGTGGCGTGCAGAACCACAAAAATACTT
TAAAAAACATGGGTATACAATAACAGTGCAATACGATAATGATAAAACAA
TACTATGGATTATACAAACTGG |
| 50 | HPV56 [1961 bp] | ACGTGGAGGTGGTGGTGGTCTTGTGGGTGTTGTATTCGTTAACAGT
TTCAACAGGGGATACGTTGTATCTACAGGTACTAGACACAGAGTCAGGAC
AATAAAATACTCTCATTTTCCATATGTACTTCCCATATGTTTTTACACCCAAA
TTTTTTGGCCTCTTGTTCAAAGTCTGTGTAGTATGTTTTGTGGCCATCATGT
ACATAATATATACCTCTATAGTCTACCCCAGAACACACTTTTTGCCACCCA
CAATCTCCATTGTAATATATATATTTCCAGGCTACATATTGCATACAATTG
TTTTTACTACCATCAAACCATACTTCTATATGTTGTCCTTCTTTTTTAAAGC
ATTTTTTAGGTTCAGTAAGCCATAGTTCCTCGCATGTGTCTCTTAATGTCCA
CTCTTCATTGTTATATATTGTTGTACTTAATGATTCCAGTGCTATTTGCACT
TCTATTGCACTACATGCTTTTGCTTTACATACTTGTAAACAAGGCACCATC
TGGTGGTTTAGTACAGTAATGTCATTTTCTCTTGCTTTATAGTATAGCACAT
TTTCATGTCGCACAGCTTTCCAATATTCTATATGATCTGCAATACATCTACT
ATCTTTTTCAAAACAGTCTAGTATTTTGTTCTGGCACGCATTTAAACGTTG
GGAAAGCGTCTCCATTGTTTTCTTTGTCCTCGTCGTTATCCAAATTTAATCT
GGACCACGTCCTTGTAAAGAAACATTTCCAGTTTACATTACTTAATTCATA
TACAGGATTACCATTATTATCTAATGGAAATGGATTTTGAAACTGAAACAC
TAACATTCTACTGTGTAAATATCGTAATTTAGCATCTAGCATAGGATTTAT
ATTGGTTGTAATTAGTAATGGTGGACATTTTATTTGTACTAATTGTTTATGT
TTTCTATCTAAACTTATAGGATTTCCATCTACCAAATTCCTTAAATAATCGT
CTATATATTTCCAACATATTTCTGTTGCATCATCCAACAACCCAAGTTTAG
CATTGTCTAATGGCTGCAACCAAAAGTGGCTTTGTGAATTCACAAATGAA
ATGACAGACCCTTGAAAAAACTTTATAAGACTCATAGCAAAGCATGATTT
ACCTGTATTTGGCGGTCCACAAAGTACCAAACAGTTATGTTTAGGTGTTCC
TTGTAGAAATAATTTAAAGTAACTTAGAAATGAAATGAAATCGACCCCTT
GATATCTTAAAAATTGTACAATGGGTTTCCAATCACCCCCTTCATCTGTTTT
ACTACATATGTGCTTTATCCACTGGCACATATTCATTTGTTGCTGTTGTGCC
CTTTTATAATGTCTACACATTATTCCACAATCCTTTACATATTTTGCCTGCA
TATTGCTTTTTAAAAAGGCTTGTGCATTGCTGTCTACATCTGCTAATTGTGC
ATATTGAAACGCAATTTGGCTATCATCTGTTACTTCATTATCAAATGCCCA
CTGCACCATTTTAGATAATTCAAATTGACTATCCTGTAAACTGTGTTGCAA
TTGTGTTTGTCTTTGTATCCATTCTGGTGTGTCTCCATACACATCACTAATA
TTTGACATTGCTGTTTTATAAAAATATAAAGCTACAGCAGGACTTCGTATT
TTTGGTGGTTGAATTAACATTTGCTCCTGTGGTACATTTAATATTGAGCTTA
ATGCTTTTGCAATTGTTTTCTGTTTTTGCCACATGTATATCTAATTAGCAT
CATTACTATAACCCCCCATGTACATGTTAAACATTGCATATGATAATACAT
ACAGTGTGGTTTATTATAGTTTTTAGTGCCTCGGCTAATGTTTCATTAACA
CCAAATATAGCACATATCCAATCATTGCAACATGTACTATCACTTTTAAAC
GTACGCACCAATTCTGAAAATGGAATACCATACACTTCTTTAAATTTATAA
TATAATTTACC |
| 113 | HPV56 [1962 bp] | CTCTAGCTTCCCGGCAACAATTAATAGACTGGATGGAGGCGGATAAAGTT
GCAGGACCACTTCTGCGCTCGGCCCTTCCGGCTGGCTGGTTTATTGCTGAT
AAATCTGGAGCCGGTGAGCGTGGGTCTCGCGGTATCATTGCAGCACTGGG
GCCAGATGGTAAGCCCTCCCGTATCGTAGTTATCTACACGACGGGGAGTC
AGGCAACTATGGATGAACGAAATAGACAGATCGCTGAGATAGGTGCCTCA
CTGATTAAGCATTGGTAACTGTCAGACCAAGTTTACTCATATATACTTTAG
ATTGATTTAAAACTTCATTTTTAATTTAAAAGGATCTAGGTGAAGATCCTT
TTTGATAATCTCATGACCAAAATCCCTTAACGTGAGTTTTCGTTCCACTGA
GCGTCAGACCCCGTAGAAAAGATCAAAGGATCTTCTTGAGATCCTTTTTTT
CTGCGCGTAATCTGCTGCTTGCAAACAAAAAAACCACCGCTACCAGCGGT |

TABLE 2-continued

| SEQ ID NO | HPV Type [Length] | Sequence |
|---|---|---|
| | | GGTTTGTTTGCCGGATCAAGAGCTACCAACTCTTTTTCCGAAGGTAACTGG
CTTCAGCAGAGCGCAGATACCAAATACTGTTCTTCTAGTGTAGCCGTAGTT
AGGCCACCACTTCAAGAACTCTGTAGCACCGCCTACATACCTCGCTCTGCT
AATCCTGTTACCAGTGGCTGCTGCCAGTGGCGATAAGTCGTGTCTTACCGG
GTTGGACTCAAGACGATAGTTACCGGATAAGGCGCAGCGGTCGGGCTGAA
CGGGGGGTTCGTGCACACAGCCCAGCTTGGAGCGAACGACCTACACCGAA
CTGAGATACCTACAGCGTGAGCTATGAGAAAGCGCCACGCTTCCCGAAGG
GAGAAAGGCGGACAGGTATCCGGTAAGCGGCAGGGTCGGAACAGGAGAG
CGCACGAGGGAGCTTCCAGGGGGAAACGCCTGGTATCTTTATAGTCCTGT
CGGGTTTCGCCACCTCTGACTTGAGCGTCGATTTTTGTGATGCTCGTCAGG
GGGGCGGAGCCTATGGAAAAACGCCAGCAACGCGGCCTTTTTACGGTTCC
TGGCCTTTTGCTGGCCTTTTGCTCACATGTTCTTTCCTGCGTTATCCCCTGA
TTCTGTGGATAACCGTATTACCGCCTTTGAGTGAGCTGATACCGCTCGCCG
CAGCCGAACGACCGAGCGCAGCGAGTCAGTGAGCGAGGAAGCGGAAGAG
CGCCCAATACGCAAACCGCCTCTCCCCGCGCGTTGGCCGATTCATTAATGC
AGCTGGCACGACAGGTTTCCCGACTGGAAAGCGGGCAGTGAGCGCAACGC
AATTAATGTGAGTTAGCTCACTCATTAGGCACCCCAGGCTTTACACTTTAT
GCTCCCGGCTCGTATGTTGTGTGGAATTGTGAGCGGATAACAATTTCACAC
AGGAAACAGCTATGACCATGATTACGCCAAGCGCGCAATTAACCCTCACT
AAAGGGAACAAAAGCTGGGTACCGGGCCCCCCCTCGAGATGGCGACGTG
GCGGCCTAGTGAAAATAAGGTGTATCTACCTCCAACACCTGTTTCAAAGG
TTGTGGCAACGGATTCCTATGTAAAACGCACTAGTATATTTTATCATGCAG
GCAGTTCACGATTGCTTGCCGTAGGACATCCCTATTACTCTGTGACTAAGG
ACAATACCAAAACAAACATTCCCAAAGTTAGTGCATATCAATATAGGGTA
TTTAGGGTACGGTTGCCCGACCCTAATAAGTTTGGGCTTCCAGATACTAAT
ATTTATAATCCGGACCAGGAACGGTTAGTGTGGGCATGTGTAGGTTTGGA
GGTAGGCCGCGGACAGCCTTTAGGTGCTGGGCTAAGTGGCCATCCATTGT
TTAATAGGCTGGATGATACTGAAAGTTCCAATTTAGCAAATAATAATGTTA
TAGAAGATAGTAGGGACAATATATCAGTTGATGGCAAGCAAACAC |
| 51 | HPV56 [210 bp] | TTAGCTAATGGGTCCTGTTTTTCTGTTGGTGGCTGTTCCCGTTGACATGT
TATAGCTGTGCTTCTAACATATCTATATTTATCTTCTAGGCTGGTGGCCACT
GGCGGGGATAACCCAATATTCCAGTCCTCCAGTAGGTTAGCATTCATATTA
TGTAAATATGCCATAACCTCTGCAGACAAAGTAATTTTGCATAATTGAAA
AACAAAT |
| 52 | HPV58 [1300 bp] | TTGTGATGTTAAATCATTTTTATCAGCTTCGTATATGTCTAGGATTTTGT
CCTGCACTGCACTTAAACGTGCTGATATTTCCTCCATCGTTTTCCTTGTCCT
CTTCCTCTATTAAGCCTAATTTGCACCACGTCCTTGAGAAAAAGGATTTCC
AATTTTCATCATTTATTTTTATACACTGGATTACCATTTGCATCAAATGGAA
ATGGATTGTTAAATTCAAATACTGTTAGTCTACTGTGCAAATATGGCCATC
GTGAATCTTTGCCTGCATTTGTATTTGAGGTAATTATTAATGGTGGACATT
TTAATTGTACTAATGCCCTATGTTTTACATCTATTGAAATGTCGTTACCATC
TAATGCATTTCTCATATAATCATCTATATATGTCCAGCTTATGGCTGTTACA
TCATCTATCATACCTAGTTTAGCATCTGATAATGGCTGCAACCAAAAATGA
CTTTTGGAATTTACATATGAAATAATGCATCCTTTTAAAAAATGTATTAAA
CTCATTCCAAAATATGATTTCCCTGTATTTGCTGGGCCACACAGTAACATA
CAACTTTTTTTTGGTACACCTTGTAAAAACTGTTTAAATGCAACTAAAAAT
GCTGTAAATTCAATATTTTGATATCTTAAAAATTGTACTATTGGTCTCCAA
TTACCTCCATCATTTGTTTTTTCACACCTACTTTGTATCCATTGTCCCATTGT
CATACCACGCTTTTCTGCTCTTTTATAATGTCTGCACATAACGCCACAGTCT
TTTACTATTTTTGCTTGTGCATTGCTTCTTAAAAATGCTGCTGCATTACTAT
TAACATCTGCTAACTGTGCATATTTATATGCAATGTCACTATCATCTGTAA
TGTCATTATCATATGCCCATTGTATCATTTCACTTAAATCAAATATATCATC
ATTAAAGCTATGCTGTAACTGTTAATCTATCTATCCATTCTGGTGTTGTC
CCTTGCACATCACTTATATTTGACATTGCTGTTCTAAACCAATATAAGGCA
CATGCTTGACTTCGTAATTTTGGTGGCTCGATAATCATACATGTTTCAGGA
ATTGATAGTAAATTACTCATTAATTTTGCCACAGTTAATCTATTTTTGCTAC
ATTTAAATCTAATTAACAATAATAATATAATTCCTCGTCACACGTTAAAC
ATTGTAGGTGTGTATATATACTGTGCTGTTTAATTAGTACTTTTAAACTTTC
TGCTACGGAGGGACTTATTCCATACCCTGTTATACACCAATCTGTACAGCT
TGTTTTATCACTTTTT |
| 53 | HPV66 [1655 bp] | TTTTTTAAAACAGTTTTTGGGCTCCGTGCGCCACAGTTCATCACATGTA
TCACGTAATGTCCACTCTTCATTTTTATATATTGTGTTACTTATTGCTTCCA
GTGCCATTTGTAATTCTATTGCACTACATGCTTTTGCTTTACACACTTGTAA
AGAGGGCACCATCTGGTGGTTTAGTACATTAATGTCATTTTCTCTTGCTTT
ATAAATATAATACATATTCATGTCGTACAGCTTTCCAATAGTTTATATGATC
TATAATGCATTTACTATCTTTTTCATAACAGTCTAGTATTTTGTTCTGGCAC
GCATCTAAACGTTGGGATAGAGTCTCCATTGTTTTCTTTGTCCTCGTCGTTA
TCCAAATTTAATCTGGACCATGTCCTTTCAAAAAAACATTTCCAATTTACA
TTACTCAATTCATACACAGGATTACCATTGTTATCTAATGGAAATGGATTT
CAAACTTAAACACTGAAATTCTACTGTGTAGATATCCTAATTTTGCATCT
TGCATAGGATTTACATTAGTTGTAATAATGACTGGAGGACATTTTATTTGT
ACTAATTGTTTATGTTTCCTATCTAAACTTATGGGATTCCCATCTAATAAAT
TTCTTAGATAATCATCTATATATCTCCAACACGTATCTGTTGCATCATCCA
GCAAACCTAATTTGGCATTGTCTAGTGGCTGTAACCAAAAGTGGCTTTGTG |

TABLE 2-continued

| SEQ ID NO | HPV Type [Length] | Sequence |
|---|---|---|
| | | AATTAACAAATGAAATGACTGACCCTTGGAAAAAATTTATAAGGCTCATA<br>GCAAAACATGATTTACCTGTATTGGTGGTCCACACAGTACCAAACAATTA<br>TGTTTAGGCGTGCCTTGTAAAAATAATTTAAAATAACTTAAAAATGAAAT<br>GAAGTCGACCCCTTGATATCGTAAAAATTGCACAATGGGTTTCCAATCACC<br>AAGCCAAGCTTAATTCGGCTTCCCTTCATCTACTTTACTACATATATGCTTT<br>ATCCACTGGCACATATTCATTTGCTGTTGCTGTGCCCTTTTATAATGTCTAC<br>ACATTATTCCACAATCCTTTACATATTTTGCTTGCATATTACTTTTTAAAAA<br>TGCTTGTGCATTACTATCTATGTCTGCTAGTTGTGCATATAAAAAGGCAAT<br>TTGGCTATCATCTGTTACGTCATTATCAAATGCCCACTGTACCATTTTAGA<br>CAATTCAAATTGATTGTCTTGTAAACTGTGTTGCAATTGTGTCTGTCTTTGT<br>ATCCATTCTGGTGTTTCCCCATACACCTCACTAATATTTGACATTGCTGTTT<br>TATAAAAATATAATGCCACAGCAGGACTTCGTAGTTTTGGTGGTTGAATTA<br>ACATTTGCTCTTGTGGTACATTTAAAATTGAGCTTAGCGATTTTGTAATTGT<br>TTTTCTGTTTTTTTCCACATATATATCTAATTAGCATCATTACAATTACCCCC<br>CATGAACATGTTAGGCATTGCATATGATAGTACACACATTGTGGTTTTAGT<br>ATAGTTTTTAACGCTTCTGCTAATGTTTCATTAACACCAAATATTGCACAT<br>ATCCAATCGTTACAACATGTACTATCGCTTTTAAATGTTCGCACCAACTCT<br>GTATATGGCACTCCATACACTTCTTTAAATTTAAAATGTAATCTTCCTTGTA<br>CGTTACTACTTTTA |
| 114 | HPV66<br>[1634 bp] | CGAGCGCAGAAGTGGTCCTGCAACTTTATCCGCCTCCATCCAGTCTATTAA<br>TTGTTGCCGGGAAGCTAGAGTAAGTAGTTCGCCAGTTAATAGTTTGCGCA<br>ACGTTGTTGCCATTGCTACAGGCATCGTGGTGTCACGCTCGTCGTTTGGTA<br>TGGCTTCATTCAGCTCCGGTTCCCAACGATCAAGGCGAGTTACATGATCCC<br>CCATGTTGTGCAAAAAAGCGGTTAGCTCCTTCGGTCCTCCGATCGTTGTCA<br>GAAGTAAGTTGGCCGCAGTGTTATCACTCATGGTTATGGCAGCACTGCAT<br>AATTCTCTTACTGTCATGCCATCCGTAAGATGCTTTTCTGTGACTGGTGAG<br>TACTCAACCAAGTCATTCTGAGAATAGTGTATGCGGCGACCGAGTTGCTCT<br>TGCCCGGCGTCAATACGGGATAATACCGCGCCACATAGCAGAACTTTAAA<br>AGTGCTCATCATTGGAAAACGTTCTTCGGGGCGAAAACTCTCAAGGATCTT<br>ACCGCTGTTGAGATCCAGTTCGATGTAACCCACTCGTCACCCAACTGATC<br>TTCAGCATCTTTTACTTTCACCAGCGTTTCTGGGTGAGCAAAAACAGGAAG<br>GCAAAATGCCGCAAAAAAGGGAATAAGGGCGACACGGAAATGTTGAATA<br>CTCATACTCTTCCTTTTTCAATATTATTGAAGCATTTATCAGGGTTATTGTC<br>TCATGAGCGGATACATATTTGAATGTATTTAGAAAAATAAACAAATAGGG<br>GTTCCGCGCACATTTCCCCGAAAAGTGCCACCTAAATTGTAAGCGTTAATA<br>TTTTGTTAAAATTCGCGTTAAATTTTTGTTAAATCAGCTCATTTTTTAACCA<br>ATAGGCCGAAATCGGCAAAATCCCTTATAAATCAAAAGAATAGACCGAGA<br>TAGGGTTGAGTGTTGTTCCAGTTTGGAACAAGAGTCCACTATTAAAGAAC<br>GTGGACTCCAACGTCAAAGGGCGAAAAACCGTCTATCAGGGCGATGGCCC<br>ACTACGTGAACCATCACCCTAATCAAGTTTTTTGGGGTCGAGGTGCCGTAA<br>AGCACTAAATCGGAACCCTAAAGGGAGCCCCCGATTTAGAGCTTGACGGG<br>GAAAGCCGGCGAACGTGGCGAGAAAGGAAGGGAAGAAAGCGAAAGGAG<br>CGGGCGCTAGGGCGCTGGCAAGTGTAGCGGTCACGCTGCGCGTAACCACC<br>ACACCCGCCGCGCTTAATGCGCCGCTACAGGGCGCGTCCCATTCGCCATTC<br>AGGCTGCGCAACTGTTGGGAAGGGCGATCGGTGCGGGCCTCTTCGCTATT<br>ACGCCAGCTGGCGAAAGGGGGATGTGCTGCAAGGCGATTAAGTTGGGTAA<br>CGCCAGGGTTTTCCCAGTCACGACGTTGTAAAACGACGGCCAGTGAGCGC<br>GCGTAATACGACTCACTATAGGGCGAATTGGAGCTCCACCGCGGTGGCGG<br>CCGCCTGTAAAAAAATAGGGAACACGTTTACGGCGCCTACGTTTAAAAAA<br>ATATACAGGCCATAGTGCAAATGTACCTCCCTGTATATATACATCATGTGT<br>AACATCATAAGGAGACTGAGGTACAAAGGGCCAAGTACTGGGGCCTGTA<br>GGTAAAACTATATCAGGACCA |
| 54 | HPV66<br>[320 bp] | GATTACCCCAGCATATGCCATTATTATGGCCCTGTGCACGTTGCAACCA<br>ATAAGGTTTATTAAATAATTGGGCCTCAGAGGTAATCATGGACCCACTAG<br>GAGTAGCAACATATACAGAACTGGGAGGAGGGTCCCTGCCATTGCCACCC<br>TTCCAATACAAATCTGTAGGAATGGCTTCCCCAACATTACCTGCCCTATTA<br>AAGTAATGTTTGGCAAACAATTGTTCCCTGCGTAAGTAAAACCACATAGA<br>ATCCCCATAGGCATCTGCAGACATTTTTAGATAATCAGGATATTTACATGT<br>AGATTGTACAATGTCCAAT |
| 115 | HPV66<br>[320 bp] | GCGTGCCTTGTAAAAATAATTTAAAATAACTTAAAAATGAAATGAAGTCG<br>ACCCCTTGATATCGTAAAAATTGCACAATGGGTTTCCAATCACCAAGCCA<br>AGCTTAATTCGGCTTCCCTTCATCTACTTTACTACATATATGCTTTATCCAC<br>TGGCACATATTCATTTGCTGTTGCTGTGCCCTTTTATAATGTCTACACATTA<br>TTCCACAATCCTTTACATATTTTGCTTGCATATTACTTTTTAAAAATGCTTG<br>TGCATTACTATCTATGTCTGCTAGTTGTGCATATAAAAAGGCAATTTGGCT<br>ATCATCTGTTACG |
| 55 | HPV68<br>[1930 bp] | GAGTTTGTTTTTTGGTGCATGGGGCACCTGCCGTGGTATGGGTCGCGG<br>TGGTGTTCTGTAGGTCGGCAACAGATTCAGTAGTGGATACTTTTCCGTCAG<br>TGGTACTGCACATAGAGTCAGGACAATGGATTATGTTGCCATTATAATGC<br>ACGTCCCATTTTCCACTAGTCCCATATAGTTGTGCATCCTGCATAAACCTTT |

TABLE 2-continued

| SEQ ID NO | HPV Type [Length] | Sequence |
|---|---|---|
| | | CGTAATAGGTTTTTTGTTGTTCATACATATAATATACACCCCAGTAATCCA<br>CACGCCCTTGGGTTTTACACCATGTGTCTGTACTGTTTTTAAAGTAAATTGT<br>ACCCCACACTACATAATGCATTGAGTTACTCTTGTCCCCATCATACCATAC<br>TTCCACTGTAACACCATGTTTTTTAAAACATTGCTTTGGCTTTGTATGCCAT<br>AGTTCATTACTTGTGTCCCTTAATGTCCACTCCTCTGCACTATATGCAGTTT<br>TAGCAAGGCTCTCTAGTGCCATCTGCAGTTCAATAGCTTGATATGCTTTAG<br>TTTTTGAAATGTTTACAGGCGGCACCACCTGGTGGTCAATATTATGCATAC<br>CACGTTCTCGTGCTGCATAATATATTGCATTTTCCAGTCGCACACAATTCC<br>AATAGTTAATATGGTCCTGTATACATTTACTGTCCTGTTCATAATGTTCTAA<br>TATTTTCTCCTGTAACACATTTAAACGTTGGGAAAGTGTTTCCATCATTGTC<br>TCCTTCATCCTCGTCCTGCTGCAAGTCTAATCTGCACCAAGTCTTTTCAAA<br>AAAACATTTCCAGTTTTTATCATTGATTGTATACACTGGGTTCCTGTTTTGG<br>TCAAATGGAAATGCATTAGGAAATTTAAACACGGTTAGTCTACTATGTAA<br>ATACGGCCACCTATTGTCTTCTACAGGGTTAGTATTGGATGTTATTAGCAT<br>TGGTGGACACTTTATTTGTATTAGGTGTCTGTGTTTTCTATCTAAACTTATT<br>GGGTTACCATCTAATGCATTTCTCATGTAATTATCAAAATATGACCAGCAT<br>GTACCTGTTGCGTCATCTAGCATGGCTATTTTTGCATCTGCAAGTGGCTCT<br>AACCAAAAGTGACTTGCTGAATTTACATATGAAATTATTGTGCCTTGTAAA<br>AAATGTATAAGGCTCATGCAAAAATATGACTTGCCTGTATTTGGCGGCCC<br>ATGTATAACTATACAATTTCGTTTTGGCGTGCCTTTTAAAAAATCTTTTAAT<br>GCACATAAAAATGTTATAAATTCCAGTCCTTGATATCTTAAAAATTGTACA<br>ATTGGGCGCCAATCACCGCCTTCGTCACATTTACTGCATCTAAATTTAATC<br>CATTGTGGCATTGTCATTTGTCGTTTTTGCGCCCGTTTGTAATGTCTACACA<br>TTGTTGCACAATCTTTTACATATTTTGCTTGACAGTTGCTTTTTAAAAACGC<br>TGCAGCATTACTATTACAATCTGCTAACATAGCATATTGAAATGCTATATC<br>ACTGTCATCTGTTAACTCATTATCAAATGCCCATTGTACCATGTCTGATAA<br>ATCAAATACACTATCATCTATTCCATGTTGTATTATGGTTAATCTTTTTATC<br>CATTCCGGCGTGTCGCCACACACCTCACTAATATTAGATATTCCTGTTCTA<br>TACCAATATAATGCTGCAACAGGGCTACGTAATTTTGGTGGCTGCAAAAG<br>CATACAGCTGTCTGGAACATGCAACAATGTACTCAATCCTTTTCCTACTGT<br>TATTCTATTTTTTCCACATTTGTATCTTATTAGCATTAGTATTAATATTCCA<br>GTTTTTGTATCTAAACATTGTATATGGGTATACAATGCATATTGTTTAATTA<br>GTGTTTTAAACCCTTCCGCAATGGTTGGATTTACTCCAAATATTGCTGCTA<br>CCCAGTCTGTACATGTGGTTTTATCACTTTTAAAT |
| 56 | HPV68<br>[450 bp] | GCAAATAACTGTTCCCTACGTAAACAAAAAAACATACTGTCTCCATAC<br>ACATCTGCAGACATTTGCAAATAGTCAGGATATTTGCAAACAGATTGACA<br>TATATCCAAAGGTACCTCGCTTTTCGTTTCTTGTAATGTACCAAAGTCCAT<br>AGCACCCATATCCTGTATCAATCATATCGCCATCCTCAATAGGAGTATTTAC<br>CAATTCCAATGGGGACAGTCCCCTTGTTGTACATTGGTAGGCTTACAAGA<br>TTTACCTTTGGCCCAGTGCTCGCCAATAGCAGGAACACAGCCTATAATACA<br>CAGCTGTGTTTGTTTACAGTCCACTGCAACATTGTCCCTACTGTCTTTAGG<br>ATTTTTATTAGAGGAAAACGGGGAATTTTCAGTATCATCCAGCCTATTATA<br>TAGTGGATGCCCACTAAGGCCAACGCCCAATGGCTGCCCCCTACCT |
| 57 | HPV73<br>[640 bp] | ATGTTGGCTTTGGAGCCATGGATTTTAAAGCTTTACAAGCAAATAAAA<br>GTGATGTACCTATTGATATTTCTAACACTACCTGTAAATACCCAGATTATT<br>TAGGCATGGCTGCTGATCCCTATGGTGATTCCATGTGGTTTTATCTTCGTA<br>GGGAACAAATGTTTGTTCGACACTTATTTAACAGGGCTGGTGATACCGGT<br>GATAAAATCCCAGATGACCTAATGATTAAAGGCACAGGCAATACTGCAAC<br>ACCATCCAGTTGTGTTTTTATCCTACACCTAGTGGTTCCATGGTTTCTTCA<br>GATGCACAGTTGTTTAATAAACCTTATTGGTTGCAAAAGGCACAGGGACA<br>AAATAATGGTATTTGTTGGCATAATCAATTATTTTTAACTGTTGTAGATAC<br>TACTAGAAGCACTAATTTTTCTGTATGTGTAGGTACACAGGCTAGTAGCTC<br>TACTACAACGTATGCCAACTCTAATTTTAAGGAATATTTAAGACATGCAGA<br>AGAGTTTGATTTACAGTTTGTTTTTCAGTTATGTAAAATTAGTTTAACTACT<br>GAGGTAATGACATATATACATTCTATGAATTCTACTATATTGGAAGAGTGG<br>AATTTTGGTCTTACCCCACCACCGTCAGGTAC |

Linear probes are then generated from the plasmids. This can be accomplished in a number of ways, including but not limited to: cleaving the plasmid with, for example, a restriction endonuclease and/or amplifying a portion of the plasmid by, for example, sequence-specific polymerase chain reaction.

Figure 31:
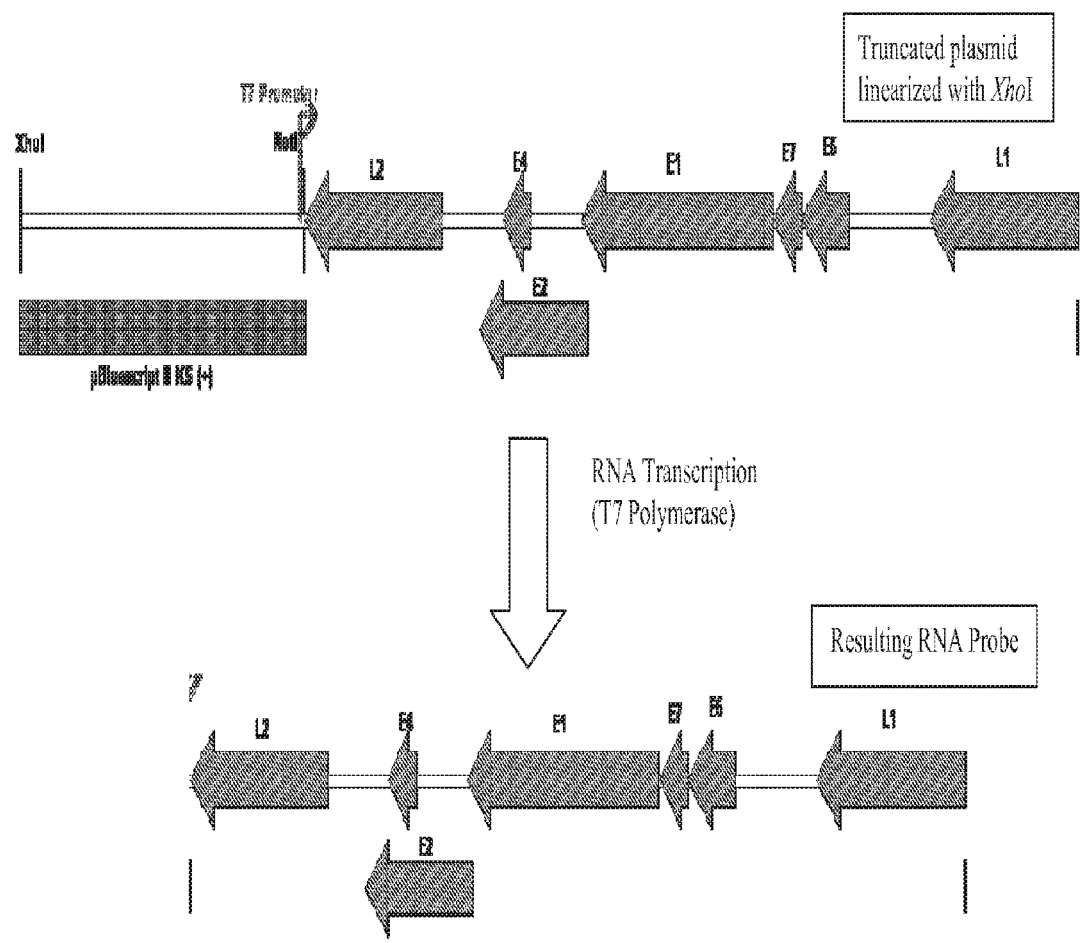
FIG. 31 demonstrates an exemplary scheme for generating linearized probes from truncated plasmids. To introduce uniformity, each template is cloned from L2 to L1 as XhoI/Not I fragments with a promoter sequence (ctcactatagggcgaattgg) (SEQ ID NO: 96). Cloned in this manner, all of the HPV nucleic acids are in the same orientation and can be linearized with one enzyme, XhoI, prior to RNA transcription. The T7 polymerase initiates RNA transcription at the promoter sequence, which terminates at the end of L1 to produce the full length probe without including any of the vector sequence. The sequence of each linearized RNA probe generated in this manner is set forth at SEQ ID NO: 97-105.

In one embodiment, the probes are generated by (1) linearizing the plasmid through the use of a restriction endonuclease, then (2) amplifying the probe portion of the plasmid using a polymerase and a polymerase specific promoter. For example, linearized RNA probes can be generated from the plasmids in FIGS. 22-29 by first cleaving the plasmid with XhoI restriction endonuclease, then transcribing the portion specific for HPV nucleic acids with T7 RNA polymerase. This is depicted at FIG. 31.

3. Test for Cross-Reactivity with LR-HPV

An in vitro transcription RNA probe set was generated from the truncated plasmids were tested according to the method described in Example 1 to the probe set to determine if cross-reactivity with LR-HPV was reduced or eliminated. A second deletion was made if significant cross-reactivity was still apparent after the first deletion. The deletion primer sequences are set forth in the following table:

TABLE 3

| HPV | SEQ ID NO | SEQUENCE |
|---|---|---|
| 26X | 58 | 5' GTATTTCAATTGCCTGCCATGCCGTGTAACACTGTTTACATGTGTGTC 3' |
|  | 118 | 3' GCTGACGTTACGATATACATAAAGTTAACGGACGGTACGGCA 5' |
| 26XX | 60 | 5' GTTTCGGCCGTGTAACCAGTATGGCTTATTAAATAGTTGT 3' |
|  | 119 | 3' ATTCCCTGCAAACCACGGATCAAAGCCGGCACATTGGTCA 5' |
| 33X | 62 | 5' TTTATCTAATGTCTTACTAATTCCATAAAACTTATTCCAT 3' |
|  | 63 | 3' ACCGAACATGATATGACACTAAATGAATTACAGAATGATT 5' |
| 52X | 64 | 5' GAAACACATATGGAAGGAAATTTATTTACTTGGTGAGTGT 3' |
|  | 65 | 3' GTGTCGACAATTTATATGGTCTTTGTGTATACCTTCCTTT 5' |
| 58X | 66 | 5' TAGACCATTTATTGAACATTGGAAACTAATACGCATGGAG 3' |
|  | 67 | 3' CATTCAAAATACCTTAATCAATCTGGTAAATAACTTGTAA 5 |
| 39X | 68 | 5' AATGCTAATAACTTACTACCGAATTATCAAACACCACCGC 3' |
|  | 69 | 3' TTTGTTCCTCATGATTAAAATTACGATTATTGAATGATGG 5' |
| 39XX | 70 | 5' GTCACCCACCTATCAATCATATCACCATCCTCAATAGGGG 3' |
|  | 71 | 3' ATGTTAACCCGTCCTTACCGCAGTGGGTGGATAGTTAGTA 5' |
| 56X | 72 | 5' CAATTTACAACCGTGGGCAACCAAGACGCCGCAGTATCC 3' |
|  | 73 | 3' GTCCTGAACAAATTTTCATCGTTAAATGTTGGCACCCGT 5' |
| 56XX | 74 | 5' ATGAATTACAATATAAATTTTGGGATGTTAACTTACAGGA 3' |
|  | 75 | 3' GGAATCTGTACACCTCCTTATACTTAATGTTATATTTAAA 5' |
| 66X | 76 | 5' AGGAACTATTGAAGGACAACATATAGAAGTGTGGTTTGAT 3' |
|  | 77 | 3' TTGTGGTTGTGTGGTTAACGTCCTTGATAACTTCCTGTTG 5' |
| 66XX | 78 | 5' CTGAGGTGCCAGGTATTTGTTACTGTTGTGGATACTACCA 3' |
|  | 79 | 3' CGTTAATGTCCTTAGTTTCCGACTCCACGGTCCATAAACA 5' |
| 68X | 80 | 5' CTGGTACGTACGACGTCGTCTCGGAAGTATCCCAGACAGT 3' |
|  | 81 | 3' TACCTAACAGTAAATTACTGGACCATGCATGCTGCAGCAG 5' |
| 68XX | 82 | 5' AAAATGCCTGATTTCAACACCAACACAGGCCCATACCATG 3' |
|  | 83 | 3' TGGTACGGAGGGGATAAGGTTTTTACGGACTAAAGTTGTG 5' |
| 73X | 84 | 5' ATTGCTAGCACAGTAGAGGTTAGATATGACTGTGAAAAGG 3' |
|  | 85 | 3' TCCTTATTACGTTTTCGTCGTAACGATCGTGTCATCTCCA 5' |
| 73XX | 86 | 5' TTCCTCTAAACTATCATATCACCATCCTGTATAGGGGTGT 3' |
|  | 87 | 3' CTACAATGTATAGATATACAAAGGAGATTTGATAGTATAG 5' |

Among the selected plasmids, the total amount of deleted sequence contained in the one (X) or two (XX) deletions ranged from ~1.4 to 2.4 Kb. The final plasmid constructs resulted in HPV 33X, 52X, 58X with single deletions and HPV 26XX, 39XX, 56XX, 66XX, 68XX and 73XX with double deletions. Restriction maps of the plasmids and resultant probes are set forth in FIGS. 10 through 18. Exemplary deletions are shown above at Table 2.

4. Exemplary Workflow for Double Deletion of HPV26

Figure 20:
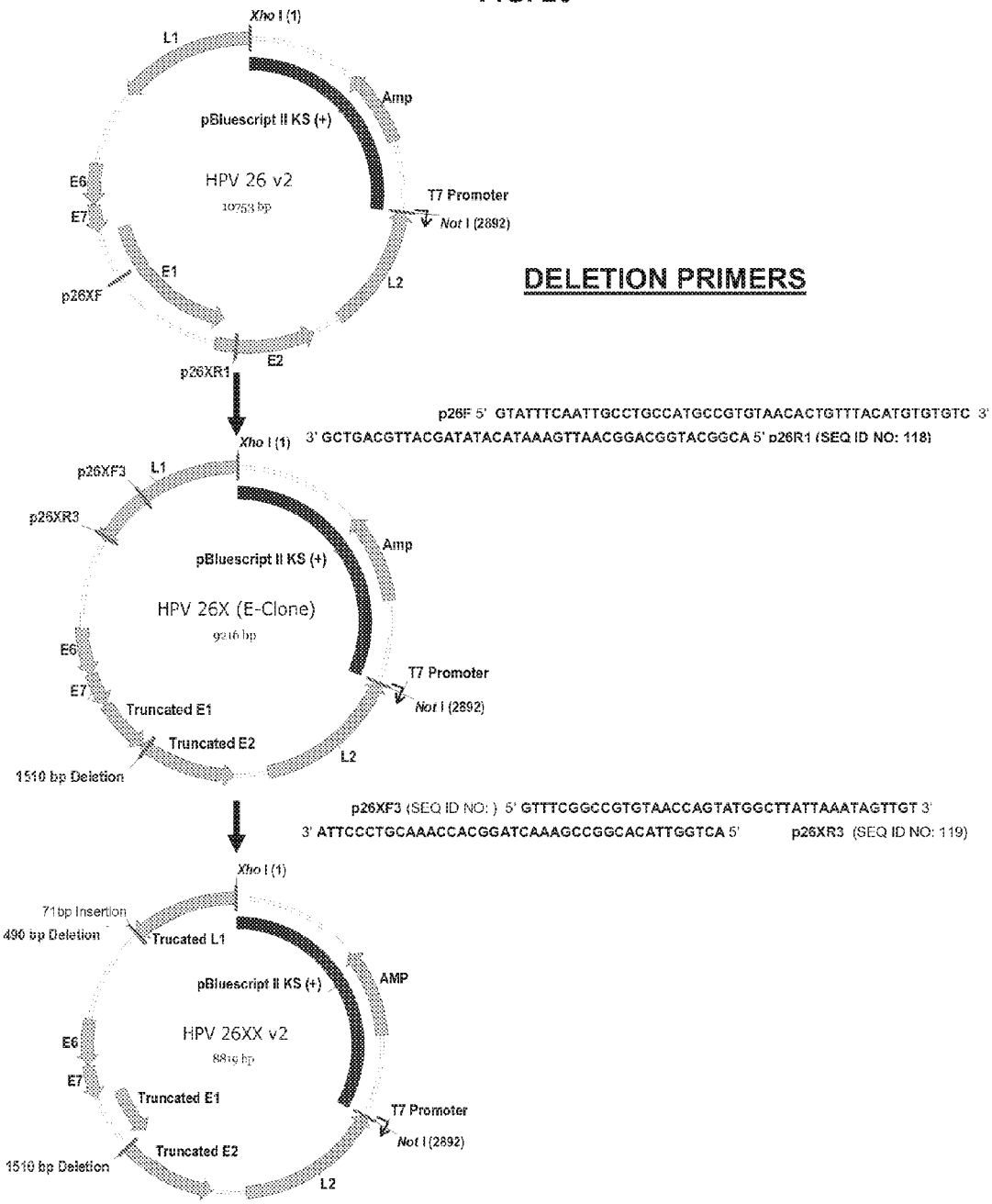
FIG. 20 demonstrates a sample schematic for generating the HPV 26XX strategically-truncated probe. 1. A methylated plasmid bearing the HPV26 sequence according to Gen-Bank accession number X74472 was amplified with the primer pair p26F and p26R1 set forth at A to generate single strategically-truncated plasmid HPV26X, which is then cloned. The binding site for each primer is indicated on plasmid HPV 26 v2. 2. After cloning, HPV26X is amplified using the primer pair p26XF3 and p26XR3 to generate HPV26XX. The binding site for each primer is indicated on plasmid HPV 26X.
Figure 22:
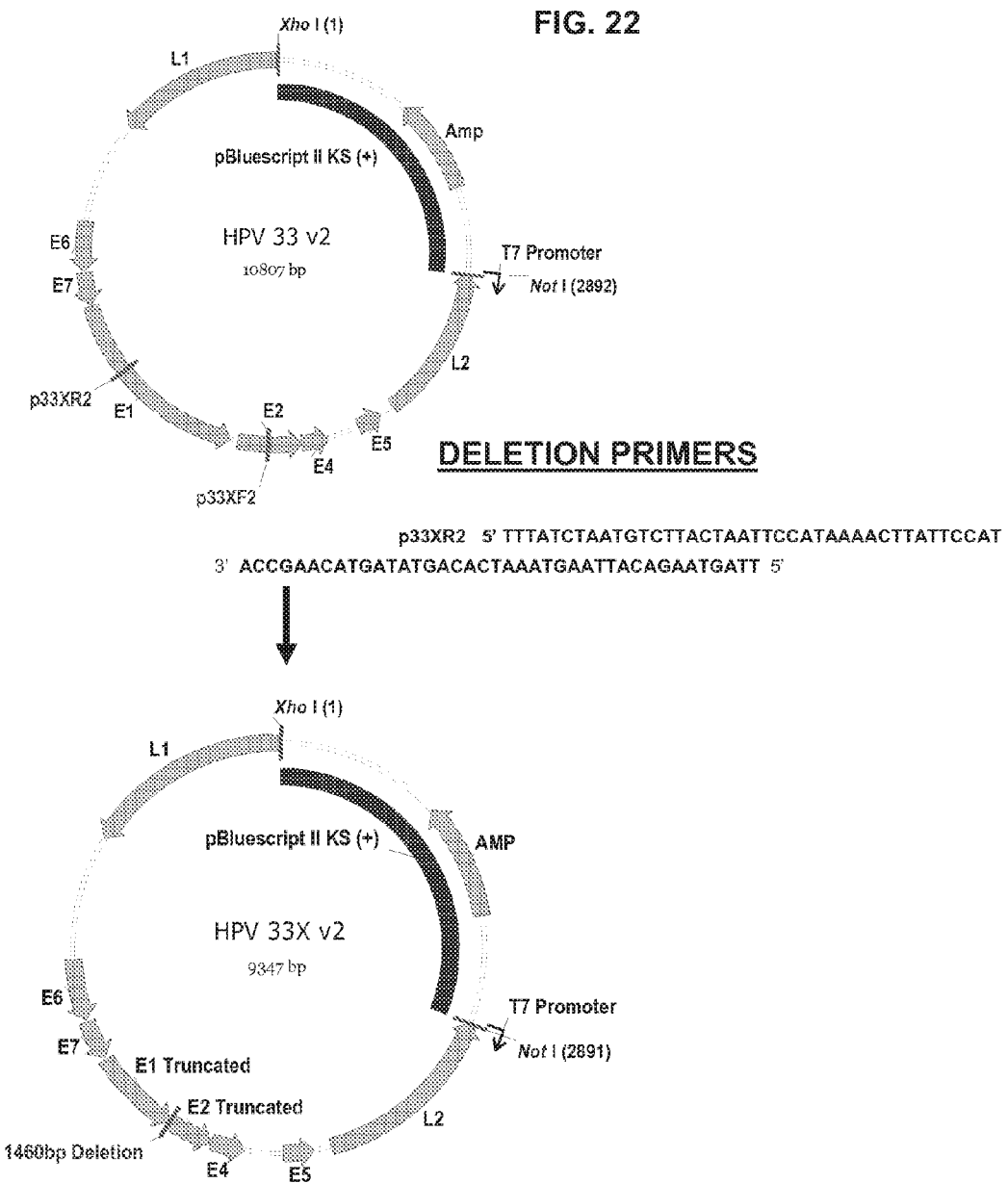
FIG. 22 demonstrates a sample schematic for generating the HPV 33X strategically-truncated plasmid.
Figure 23:
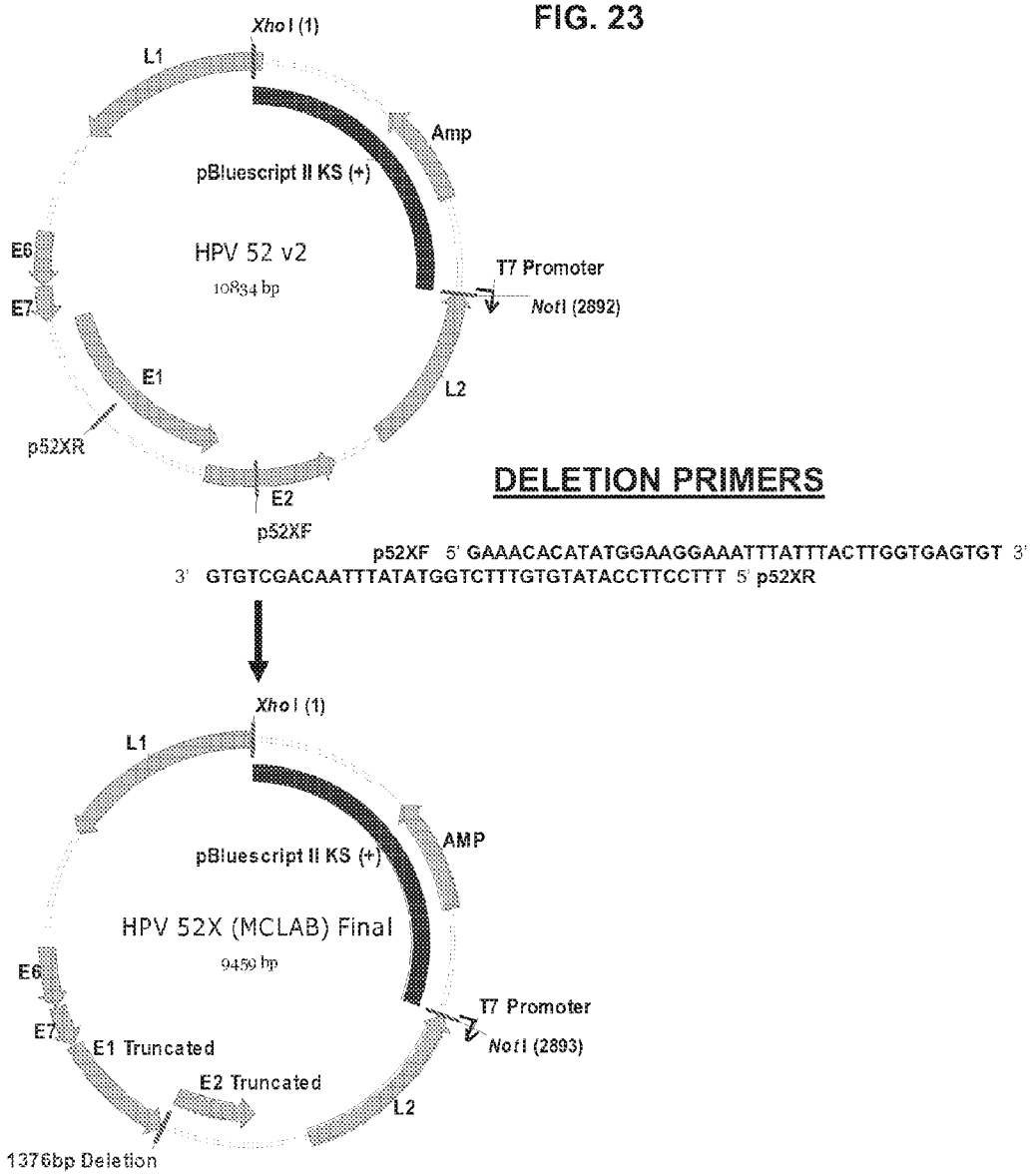
FIG. 23 demonstrates a sample schematic for generating the HPV 52X strategically-truncated plasmid.
Figure 24:
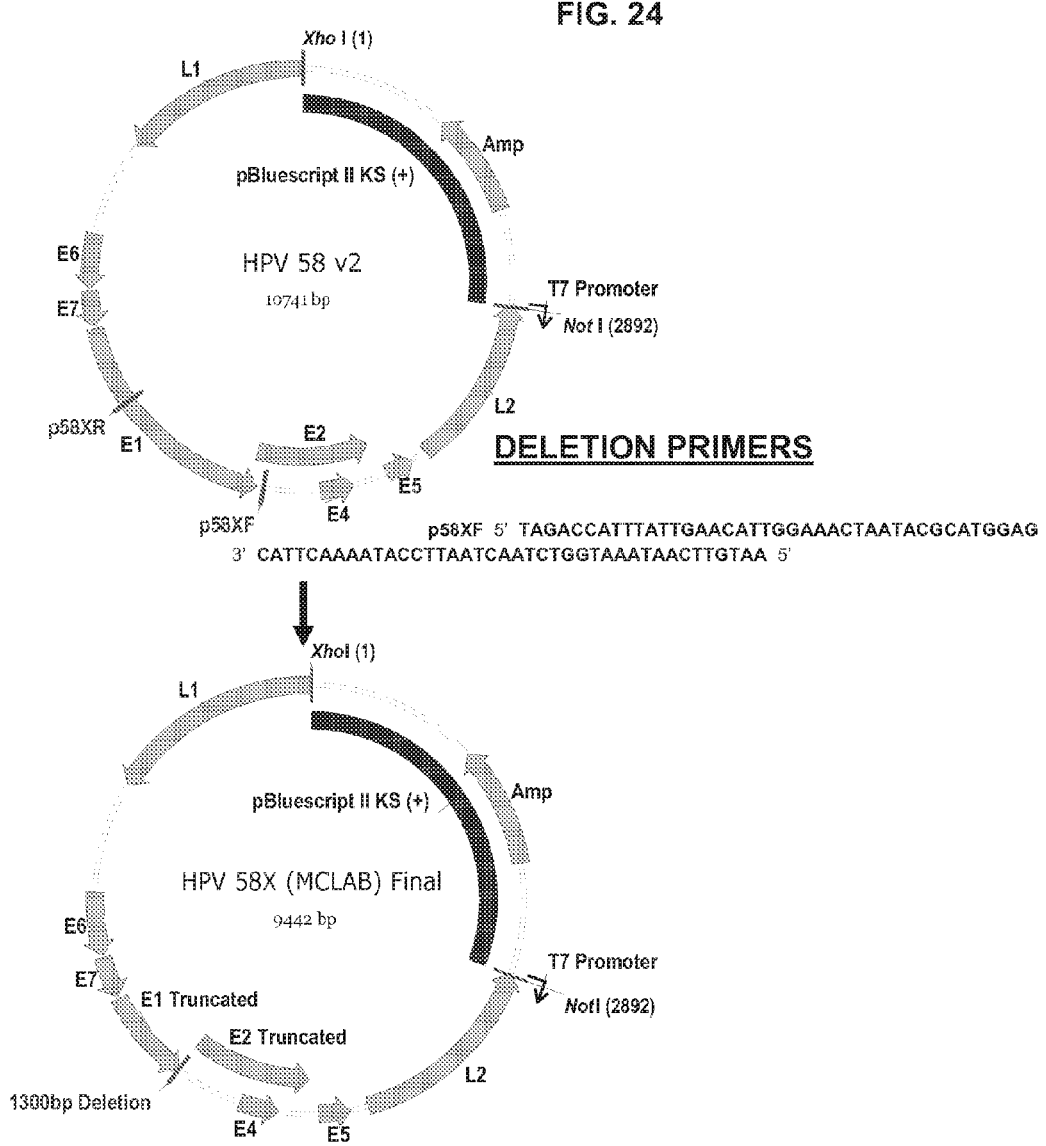
FIG. 24 demonstrates a sample schematic for generating the HPV 58X strategically-truncated plasmid.
Figure 25:
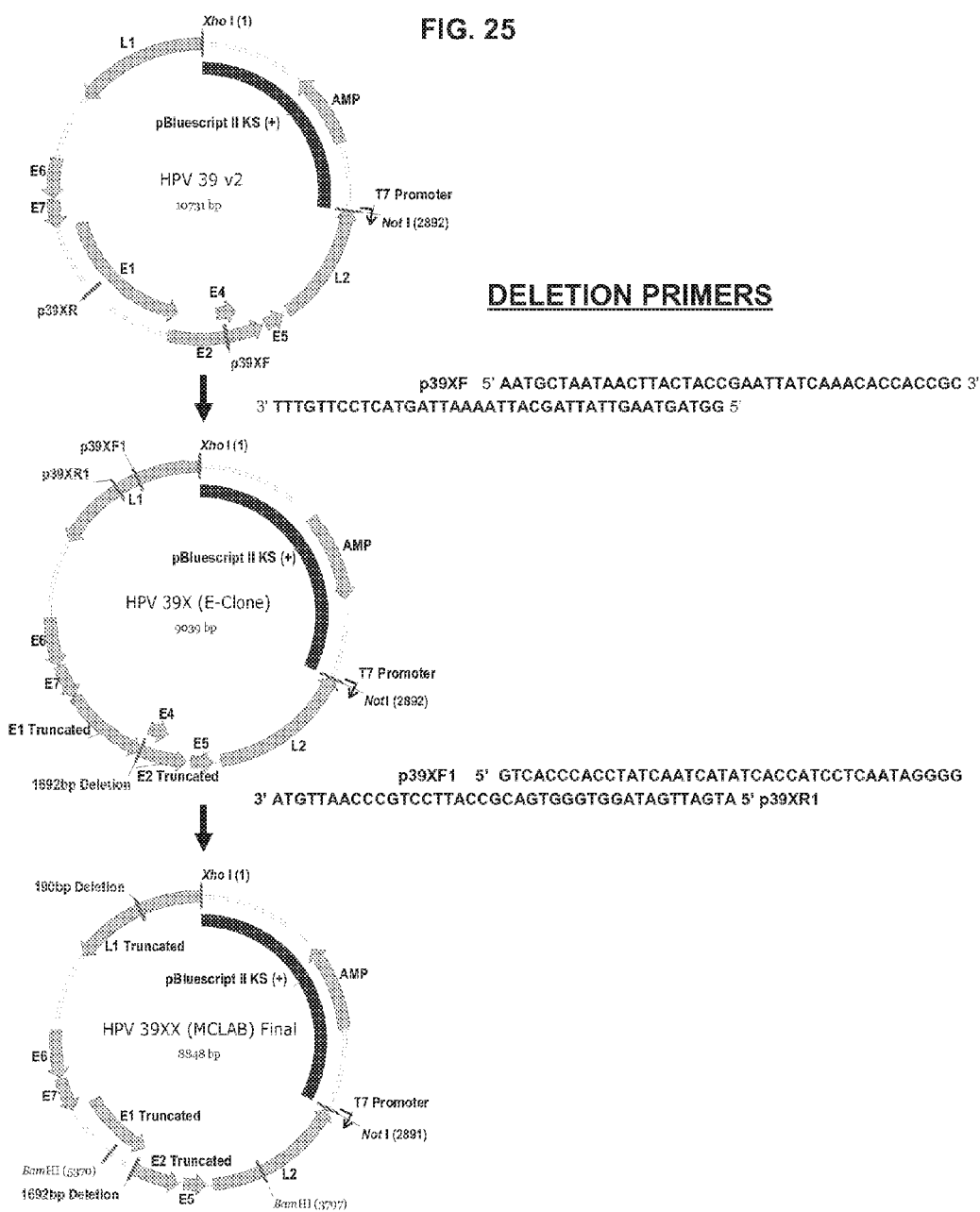
FIG. 25 demonstrates a sample schematic for generating the HPV 39XX strategically-truncated plasmid.
Figure 26:
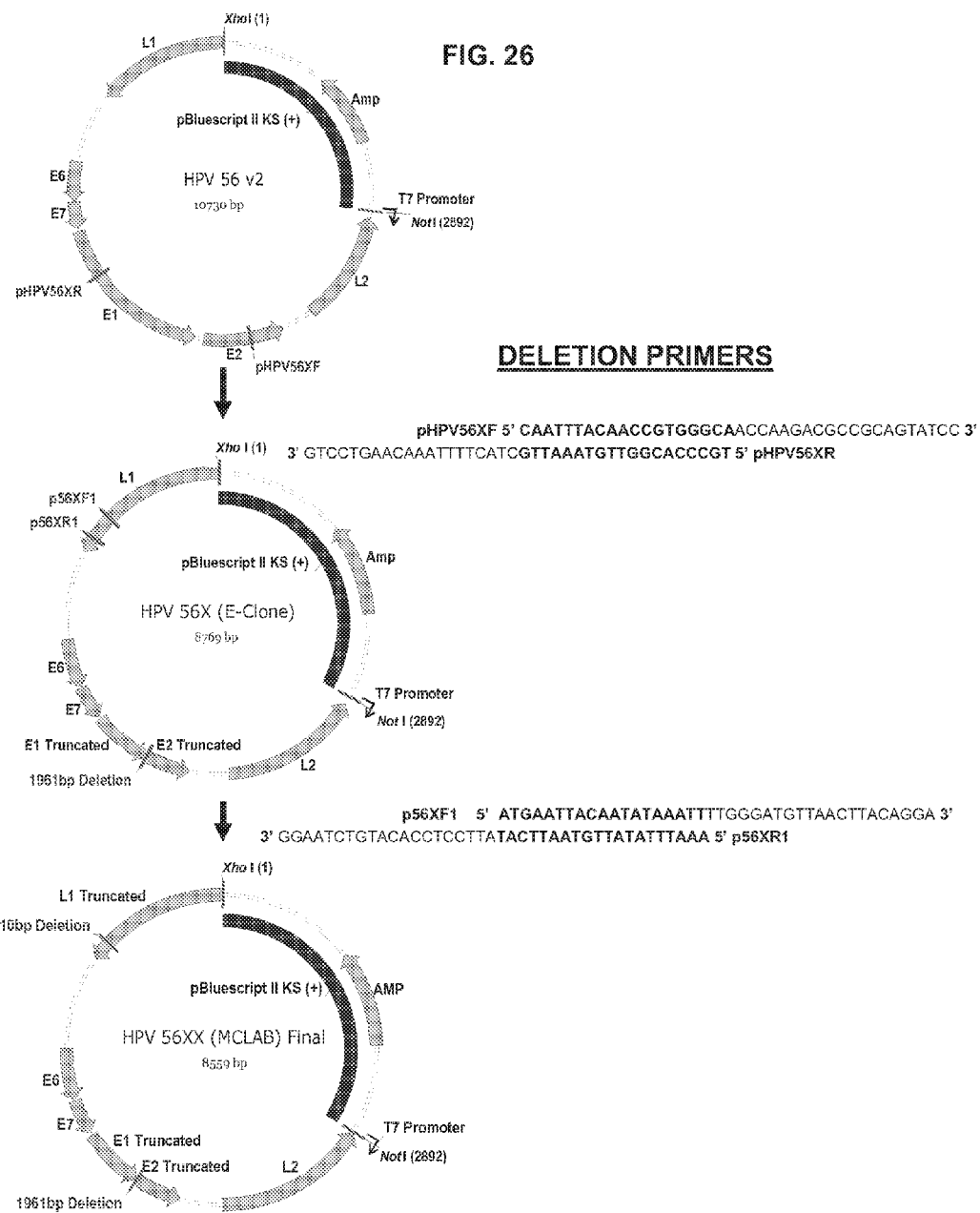
FIG. 26 demonstrates a sample schematic for generating the HPV 56XX strategically-truncated plasmid.
Figure 27:
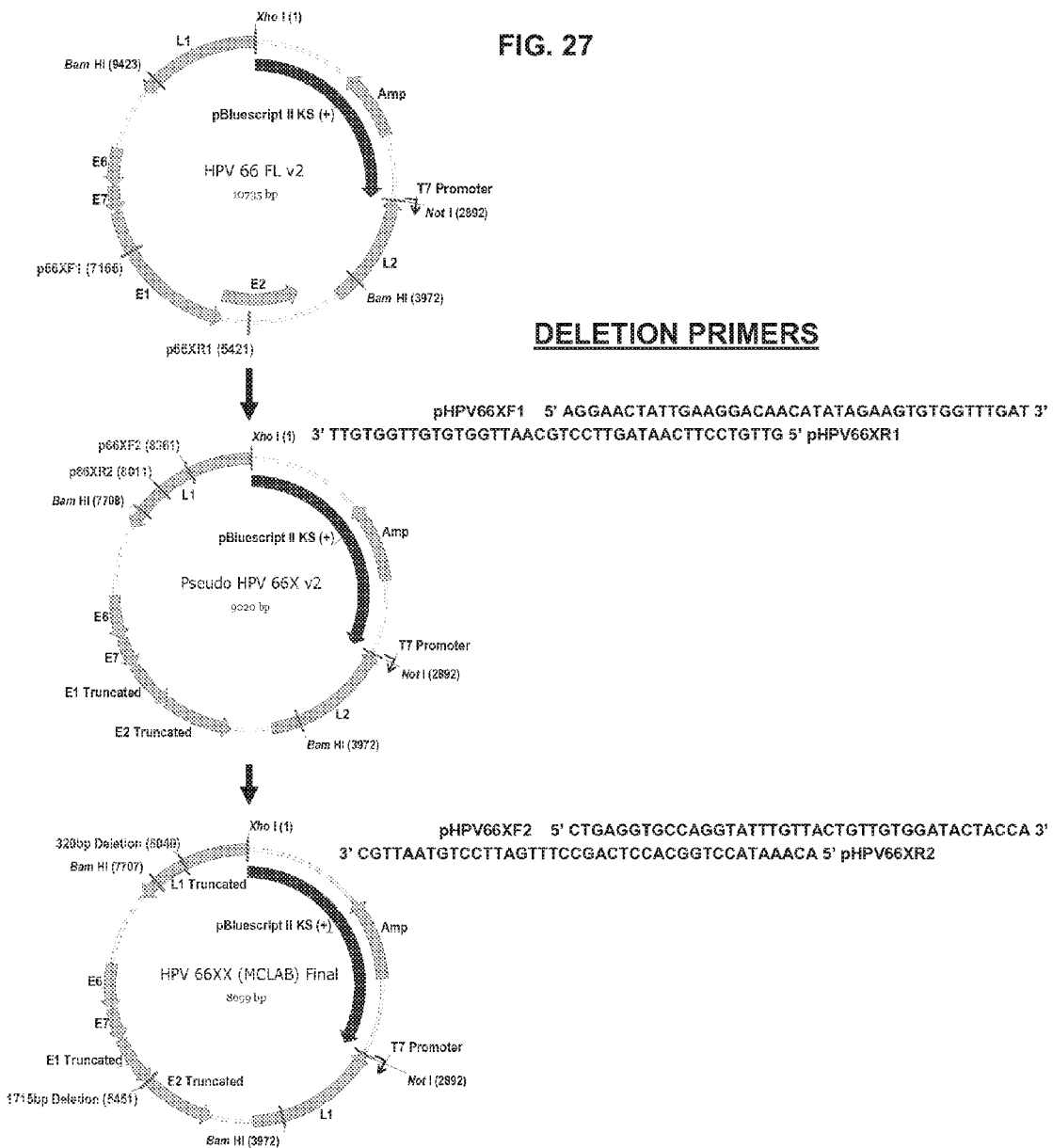
FIG. 27 demonstrates a sample schematic for generating the HPV 66XX strategically-truncated plasmid.
Figure 28:
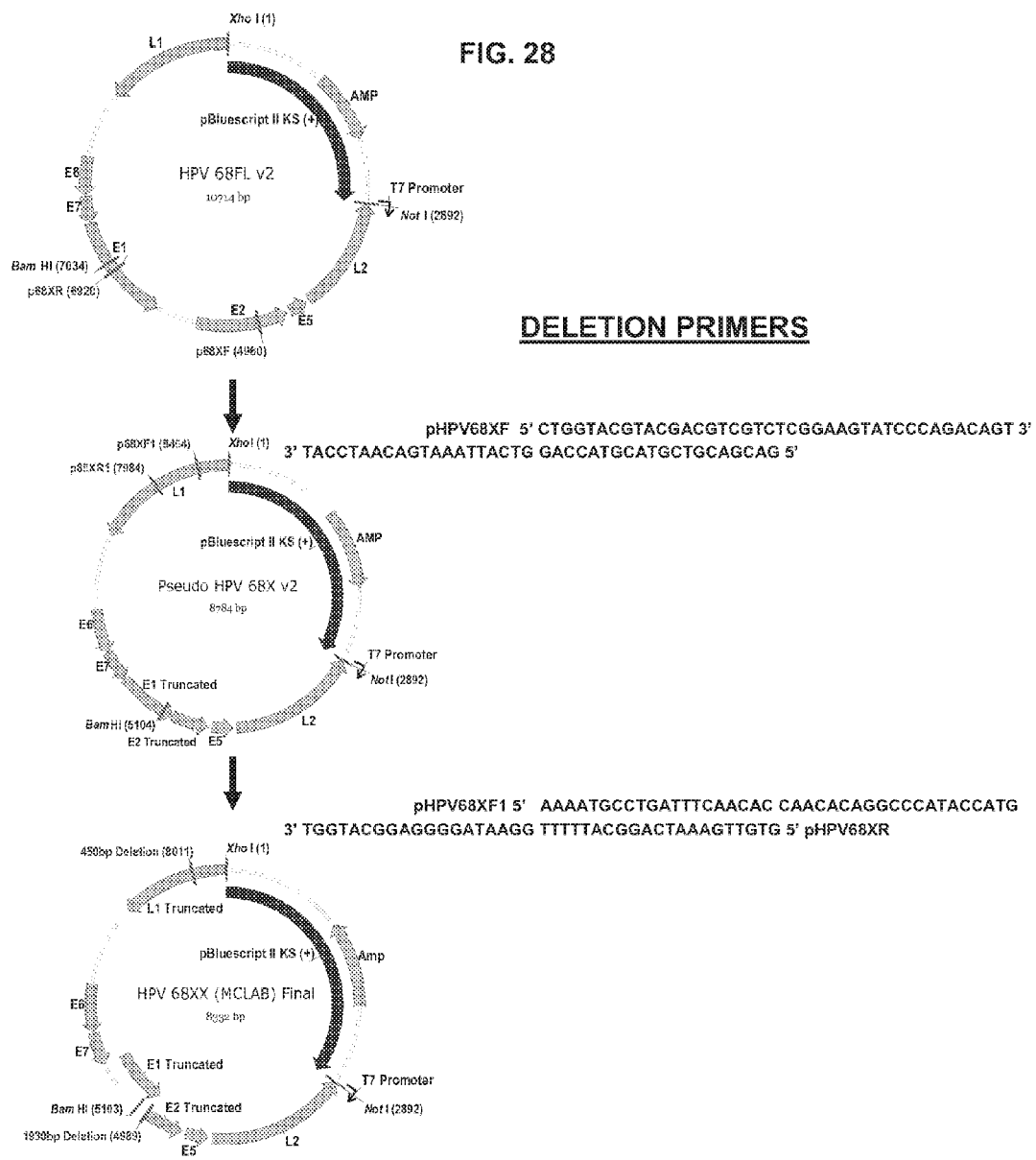
FIG. 28 demonstrates a sample schematic for generating the HPV 68XX strategically-truncated plasmid.

An example of this workflow for generating an HPV26 double strategically-truncated plasmid is depicted at FIGS. 19 and 20. A pBluescript II KS(+) plasmid bearing an HPV26 sequence according to GenBank accession number X74472 was used as starting material. After methylation, the plasmid is amplified with the following pair of deletion primers:

```
Forward Primer (SEQ ID NO: 58):
5' GTATTTCAATTGCCTGCCATGCCGTGTAACACTGTTTACATGTGTG
TC 3'

Reverse Primer (SEQ ID NO: 118):
5' ACGGCATGGCAGGCAATTGAAATACATATAGCATTG CAGTCG 3'
```

The result of this amplification deletes a 1510 base pair section of the plasmid, resulting in truncations of the E1 and E2 regions. This amplicon is then transfected into a strain of DH5α™-T1$^R$ E. coli bearing an active form of McrBC nuclease (Invitrogen Corp., Carlsbad, Calif.) to generate an HPV26X strategically-truncated plasmid.

A second amplification is then performed with the following pair of deletion primers:

```
Forward Primer (SEQ ID NO: 60):
5' GTTTCGGCCGTGTAACCAGTATGGCTTATTAAATAGTTGT 3'

Reverse Primer (SEQ ID NO: 119):
5' ACTGGTTACACGGCCGAAACTAGGCACCAAACGTCCCTTA 3'
```

This amplification deletes a 490 base pair section of the plasmid, resulting in truncation of the L1 region.

This amplicon was then transfected into a strain of DH5α™-T1$^R$ E. coli bearing an active form of McrBC nuclease (Invitrogen Corp., Carlsbad, Calif.). The E. coli circularizes the amplicons to generate an HPV26XX strategically-truncated plasmid, while McrBC digests the methylated template.

The HPV26XX plasmid was restriction mapped to confirm the structure and size. The plasmid was digested with (1) XhoI only; (2) XhoI and NotI; (3) BamHI and SpeI; and (4) HindIII. The results are shown at FIG. 21. This plasmid has the features set forth below in Table 3:

TABLE 4

| | Name | Starts At (nucleotide) | Ends At (nucleotide) | Coding Strand |
|---|---|---|---|---|
| Coding sequences (7 total) | Ampicillin Resistance Gene | 1233 | 2093 | Complementary |
| | L2 | 2878 | 4296 | Complementary |
| | Truncated E2 | 4622 | 5521 | Complementary |
| | E1/E2 Deletion (1510 bp deletion) | 5542 | 5542 | Not Applicable |
| | Truncated E1 | 5538 | 6093 | Complementary |
| | E7 | 6101 | 6415 | Complementary |
| | E6 | 6422 | 6860 | Complementary |
| | L1 Deletion (490 bp deletion) | 7809 | 7809 | Not Applicable |
| | Truncated L1 | 7796 | 8818 | Complementary |
| Misc. Feature (1 total) | pBluescript II KS(+) | 1 | 2891 | Not Applicable |
| Prokaryotic Promoter (1 total) | T7 Promoter | 2855 | 2874 | Not Applicable |

Example 2

Assay Using Cervical Samples and HPV Probes

A total of 324 physician collected cervical samples were collected in a detergent based collection medium and tested for the presence of high-risk HPV.

A 1 ml sample was vortexed to homogenize the sample and a 50 µl aliquot was removed and combined with 25 µl of denaturation reagent (1.75 N NaOH) in the assay microplate. This was shaken to mix and incubated at 70° C. for 30 minutes to create single stranded DNA. To this, 40 µl of a neutralization buffer (probe diluent –2.2M BES, 2.6% PAA, 0.7 N NaOH and 0.09% sodium azide) containing RNA probes for 16 HPV types was added to create a neutral pH and incubated at 68.5° C. for 10 minutes.

Following this, 10 µl of antibody conjugated paramagnetic beads (approximately 1 µm carboxylated SERADYN beads from Thermo Fisher) were added to the reaction and incubated for an additional 30 minutes at 68.5° C. The RNA probes and DNA target molecules that were complementary to each other bind and create RNA-DNA hybrids. The hybrids then captured by a RNA-DNA hybrid specific antibody coated on the paramagnetic SERADYN beads.

Following incubation, the paramagnetic beads are separated from the liquid phase/supernatant by exposure to a magnetic field. The supernatant waste is removed by decanting and 35 µl of detection reagent 1 (secondary antibody conjugated enzyme comprising a monoclonal anti-RNA-DNA hybrid antibody conjugated to alkaline phosphatase) is added and incubated at 45° C. for 30 minutes. The secondary antibody binds the RNA-DNA hybrid-antibody-conjugated paramagnetic bead complex. Non-bound secondary antibody is washed away using a detergent based wash buffer (40 mM Tris, pH 8.2, 100 mM NaCl, 0.1% Triton-X 100 and 0.09% sodium azide).

A substrate (dioxetane-based substrate from ABI, called DCP Star, with Emerald II enhancer) is added to the washed beads and wells that contain high-risk HPV DNA create light that is detectable by a luminometer and measured in RLUs (relative light units). An assay positive standard containing 1 pg/ml of HPV DNA is used to establish the positive cutoff. All sample RLU values are divided by the RLU value for the positive standard creating a RLU/CO (RLU to cutoff value). Results are reported in RLU/CO and anything greater than or equal to 1.0 is considered positive.

Example 3

Stability Testing

Following initial testing, samples were stored at room temperature and 33° C. to observe the stability of the samples. Testing was conducted as far as 21 days post collection. FIGS. 3 and 4 demonstrate that the RLU/CO value for each sample does not change with time up to 21 days. A 2×2 analysis comparing baseline results to the results after 21 days of storage and scatter plot analysis demonstrated the linearity of the RLU/CO values with time. Based on these data, it is possible to conclude that samples collected and stored at either room temperature or 33° C. for as long as 21 days provide comparable RLU/CO values as tested at baseline. Using linear mixed model comparison of RLU/CO values against the temperature of storage the P values are 0.8803 for room temperature and 0.9517 for samples stored at 33° C. indicating that values are equal.

Example 4

This example describes the limit of detection (LOD), the $C_{95}$ concentration, and cross-reactivity experiments using re-engineered HYBRID CAPTURE chemistry and high risk (HR) and low-risk (LR) HPV plasmid DNA constructs. LOD is defined as the copy number required to identify whether virus is detected. The $C_{95}$ concentration is defined as the copy number required to identify whether the signal for the specimen is above a presumptive clinical cutoff 95% of the time.

Two independent assays using full length complementary RNA probes that hybridize to either HPV 16 or HPV 18 and HPV45 DNA were conducted. LOD and the $C_{95}$ concentration were determined using serial dilutions of HPV 16, HPV18, and HPV45 genomic DNA and testing with the complementary RNA probes. Cross reactivity was determined using genomic DNA from LR and HR HPV types diluted to approximately $1 \times 10^7$ copies per reaction and testing with HPV16, HPV18, and HPV45 RNA probes.

TABLE 5

Limit of Detection and $C_{95}$ Concentration

| | | Probe | | |
|---|---|---|---|---|
| | Target | HPV 16 16 | HPV 18/45 18 | HPV 18/45 45 |
| Copy No. | LOD | 564 | 604 | 533 |
| | $C_{95}$ | 8,464 | 8,464 | 7,444 |

TABLE 6

High Risk Type Cross Reactivity

| | Signal to Cutoff Ratios | |
|---|---|---|
| HR Target Type | HPV 16 | HPV 18/45 |
| → HPV 16 | 172.47* | 0.13 |
| → HPV 18 | 0.22 | 93.87* |
| HPV 26 | 0.14 | 0.16 |
| HPV 31 | 0.19 | 0.19 |
| HPV 33 | 0.15 | 0.21 |
| HPV 35 | 0.23 | 0.20 |
| HPV 39 | 0.15 | 0.19 |
| → HPV 45 | 0.19 | 146.92* |
| HPV 51 | 0.15 | 0.24 |
| HPV 52 | 0.15 | 0.20 |
| HPV 56 | 0.15 | 0.20 |
| HPV 58 | 0.15 | 0.19 |
| HPV 59 | 0.15 | 0.20 |
| HPV 66 | 0.15 | 0.20 |
| HPV68 | 0.15 | 0.27 |
| HPV73 | 0.20 | 0.15 |
| HPV82 | 0.14 | 0.15 |

*where RLU/CO > 1 = Positive

TABLE 7

Low Risk Type Cross Reactivity

| | Signal to Cutoff Ratios | |
|---|---|---|
| HR Target Type | HPV 16 | HPV 18/45 |
| HPV 1 | 0.32 | 0.34 |
| HPV 2 | 0.34 | 0.37 |
| HPV 3 | 0.39 | 0.39 |
| HPV 4 | 0.27 | 0.26 |
| HPV 5-9 | 0.28 | 0.34 |
| HPV 5-48 | 0.20 | 0.23 |
| HPV 8 | 0.27 | 0.33 |
| HPV 30 | 0.26 | 0.27 |
| HPV 34 | 0.17 | 0.20 |
| HPV 40 | 0.35 | 0.34 |
| HPV 42 | 0.15 | 0.15 |
| HPV 44 | 0.21 | 0.33 |
| HPV 53 | 0.28 | 0.35 |
| HPV 61 | 0.42 | 0.48 |
| HPV 62-116 | 0.58 | 0.15 |
| HPV 62-177 | 0.24 | 0.14 |
| HPV 67 | 0.23 | 0.29 |
| HPV 69 | 0.46 | 0.41 |
| HPV 70 | 0.14 | 0.15 |
| HPV 81 | 0.55 | 0.51 |

Cervical specimens were collected at an external clinic site and placed into digene collection medium (DCM) per routine clinical procedure. Specimens were tested using the hybrid capture HR HPV DNA screening assay, and the reactive specimens and a subset of the non-reactive specimens were assayed using the hybrid capture HPV16 and HPV18/45 genotyping assays. A subset of the reactive specimens were also evaluated using HPV genotyping by GP5+/6+ PCR followed by Luminex detection. Any of the detergent-based collection medium described herein may be used, for example, the media may contain 1.0% NP-40, 0.25% sodium deoxycholate, 50 mM Tris-HCl, 25 mM EDTA, 150 mM NaCl and 0.05% sodium azide.

TABLE 8

Representative Clinical Specimen Data

| ID | HR Screen RLU/CO | HPV 16 RLU/CO | HPV 18/45 RLU/CO | High Risk Genotype | Low Risk Genotype | | | |
|---|---|---|---|---|---|---|---|---|
| 3350 | 366.8* | 156.7* | 0.28 | 16 | Neg | | | |
| 3696 | 283.9* | 0.50 | 0.20 | 35 | Neg | | | |
| 3631 | 278.0* | 328.2* | 0.20 | 16 | 40 | | | |
| 3419 | 211.2* | 0.12 | 0.15 | 52 | Neg | | | |
| 3711 | 205.2* | 0.13 | 0.22 | 56 | Neg | | | |
| 3355 | 158.2* | 0.16 | 0.15 | 51 | 74 | 83 | 91 | |
| 3718 | 154.8* | 0.19 | 117.0* | 18 | Neg | | | |
| 3463 | 141.8* | 0.13 | 0.15 | 66 | Neg | | | |
| 3514 | 124.8* | 106.8* | 0.17 | 16 | Neg | | | |
| 3637 | 65.8* | 0.17 | 0.16 | 68 | Neg | | | |
| 3576 | 50.6* | 0.13 | 0.13 | 52 | 32 | 42 | 62 | 67 90 |
| 3656 | 47.3* | 0.14 | 0.22 | 31 | 54 | 72 | | |
| 3415 | 10.2* | 0.13 | 0.15 | 82 | 28 | 85 | 86 | |
| 3366 | 9.6* | 0.11 | 5.4* | 18 35 45 | 42 | 86 | 87 | |
| 3434 | 8.6* | 0.14 | 5.2* | 33 45 | 72 | 87 | | |
| 3229 | 8.4* | 15.7* | 0.14 | 16 | Neg | | | |
| 3705 | 0.25 | 0.27 | 0.10 | Neg | Neg | | | |
| 3239 | 0.25 | 0.13 | 0.12 | Neg | 69 | | | |
| 3717 | 0.23 | 0.17 | 0.17 | Neg | Neg | | | |
| 3719 | 0.22 | 0.10 | 0.13 | Neg | 32 | | | |

Example 5

This example demonstrates the reduction of cross-reactivity of the 17 full length (B17FL) Probe cocktail compared with the strategically-truncated probe cocktail (B17XX) against eight low risk HPV types. Low risk HPV plasmid types 30, 40, 53, 61, 67, 69, 71, and 81 were used as targets at concentrations were tested: 0.5, 1, and 2 ng/mL. Results are summarized in Table 9 below.

TABLE 9

|  | B17 FL | | | B17 XX | | |
| --- | --- | --- | --- | --- | --- | --- |
|  | 0.5 ng/mL | 1 ng/mL | 2 ng/mL | 0.5 ng/mL | 1 ng/mL | 2 ng/mL |
| HPV 30 | 0.62 | 0.43 | 1.05 | 0.29 | 0.37 | 0.58 |
| HPV 40 | 0.31 | 0.29 | 0.45 | 0.24 | 0.31 | 0.45 |
| HPV 53 | 0.84 | 1.39 | 2.44 | 0.77 | 1.23 | 1.99 |
| HPV 61 | 0.40 | 0.49 | 0.81 | 0.33 | 0.39 | 0.72 |
| HPV 67 | 0.43 | 0.73 | 1.25 | 0.27 | 0.43 | 0.62 |
| HPV 69 | 4.01 | 7.90 | 14.97 | 0.73 | 1.08 | 3.09 |
| HPV 71 | 0.24 | 0.27 | 0.28 | 0.20 | 0.20 | 0.22 |
| HPV 81 | 0.37 | 0.48 | 0.90 | 0.21 | 0.26 | 0.49 |

Readout is shown in RLU/CO. All reactions having an RLU/CO greater than or equal to 1 are considered to have a high degree of cross-reactivity. As can be seen, in all cases, the full-length probe cocktail exhibited higher cross-reactivity than the corresponding strategically-truncated probe cocktail. In addition, the following full-length probes displayed a high degree of cross-reactivity: HPV 30 at 2 ng/mL; HPV 53 at 1 ng/mL, and HPV 67 at <0.5 ng/mL. This high cross-reactivity was either reduced or eliminated with the strategically-truncated probes.

SEQUENCE LISTING (119 sequences)

SEQ ID NO: 1 - DNA, 7904 bp, Artificial Sequence
  Human papillomavirus type 16 template plasmid (K02718)
actacaataattcatgtataaaactaagggcgtaaccgaaatcggttgaaccgaaaccggttagtataaaagcagacattttatgcaccaaaagagaactgcaatgtttcaggacccacaggagcgacccagaaagttaccacagttatgcacagagctgcaaacaactatacatgatataatattagaatgtgtgtactgcaagcaacagttactgcgacgtgaggtatatgactttgcttttcgggatttatgcatagtatatagagatgggaatccatatgctgtatgtgataaatgtttaaagttttattctaaaattagtgagtatagacattattgttatagtttgtatggaacaacattagaacagcaatacaacaaaccgttgtgtgatttgttaattaggtgtattaactgtcaaaagccactgtgtcctgaagaaaagcaaagacatctggacaaaaagcaaagattccataatataaggggtcggtggaccggtcgatgtatgtcttgttgcagatcatcaagaacacgtagagaaacccagctgtaatcatgcatggagatacacctacattgcatgaatatatgttagatttgcaaccagagacaactgatctctactgttatgagcaattaaatgacagctcagaggaggaggatgaaatagatggtccagctggacaagcagaaccggacagagcccattacaatattgtaaccttttgttgcaagtgtgactctacgcttcggttgtgcgtacaaagcacacacgtagacattcgtactttggaagacctgttaatgggcacactaggaattgtgtgccccatctgttctcagaaaccataatctaccatggctgatcctgcaggtaccaatggggaagagggtacgggatgtaatggatggttttatgtagaggctgtagtggaaaaaaaaacaggggatgctatatcagatgacgagaacgaaaatgacagtgatacaggtgaagatttggtagattttatagtaaatgataatgattatttaacacaggcagaaacagagacagcacatgcgttgtttactgcacaggaagcaaaacaacatagagatgcagtacaggttctaaaacgaaagtatttggtagtccacttagtgatattagtggatgtgtagacaataatattagtcctagattaaaagctatatgtatagaaaaacaaagtagagctgcaaaaaggagattatttgaaagcgaagacagcgggtatggcaatactgaagtggaaactcagcagatgttacaggtagaagggcgccatgagactgaaacaccatgtagtcagtatagtggtggaagtgggggtggttgcagtcagtacagtagtggaagtgggggagagggtgttagtgaaagacacactatatgccaaacaccacttacaaatattttaaatgtactaaaaactagtaatgcaaaggcagcaatgttagcaaaatttaaagagttatacggggtgagtttttcagaattagtaagaccatttaaaagtaataaatcaacgtgttgcgattggtgtattgctgcatttggacttacacccagtatagctgacagtataaaaacactattacaacaatattgtttatatttacacattcaaagtttagcatgttcatggggaatggttgtgttactattagtaagatataaatgtggaaaaaatagagaaacaattgaaaaattgctgtctaaactattatgtgtgtctccaatgtgtatgatgatagagcctccaaaattgcgtagtacagcagcagcattatattggtataaaacaggtatatcaaatattagtgaagtgtatggagacacgccagaatggatacaaagacaaacagtattacaacatagttttaatgattgtacatttgaattatcacagatggtacaatgggcctacgataatgacatagtagacgatagtgaaattgcatataaatatgcacaattggcagacactaatagtaatgcaagtgcctttctaaaaagtaattcacaggcaaaaattgtaaaggattgtgcaacaatgtgtagacattataaacgagcagaaaaaaaacaaatgagtatgagtcaatggataaaatatagatgtgatagggtagatgatggaggtgattggaagcaaattgttatgtttttaaggtatcaaggtgtagagtttatgtcatttttaactgcattaaaaagatttttgcaaggcatacctaaaaaaaattgcatattactatatggtgcagctaacacaggtaaatcattatttggtatgagtttaatgaaatttctgcaagggtctgtaatatgttttgtaaattctaaaagccatttttggttacaaccattagcagatgccaaaataggtatgttagatgatgctacagtgccctgttggaactacatagatgacaatttaagaaatgcattggatggaaatttagtttctatggatgtaaagcatagaccattggtacaactaaaatgccctccattattaattacatctaacattaatgctggtacagattctaggtggccttatttacataatagattggtggtgtttacatttcctaatgagtttccatttgacgaaaacggaaatccagtgtatgagcttaatgataagaactggaaatcctttttctcaaggacgtggtccagattaagtttgcacgaggacgaggacaaggaaaacgatggagactctttgccaacgtttaaatgtgtgtcaggacaaaatactaacacattatgaaaatgatagtacagacctacgtgaccatatagactattggaaacacatgcgcctagaatgtgctatttattacaaggccagagaaatgggatttaaacatattaaccaccaagtggtgccaacactggctgtatcaaagaataaagcattacaagcaattgaactgcaactaacgttagaaacaatatataactcacaatatagtaatgaaaagtggacattacaagacgttagccttgaagtgtatttaactgcaccaacaggatgtataaaaaaacatggatatacagtggaagtgcagtttgatggagacatatgcaatacaatgcattatacaaactggacacatatatatatttgtgaagaagcatcagtaactgtggtagagggtcaagttgactattatggtttatattatgttcatgaaggaatacgaacatattttgtgcagtttaaagatgatgcagaaaaatatagtaaaaataaagtatgggaagttcatgcgggtggtcaggtaatattatgtcctacatctgtgtttagcagcaacgaagtatcctctcctgaaattattaggcagcacttggccaaccaccccgccgcgacccataccaaagccgtcgccttgggcaccgaagaaacacagacgactatccagcgaccaagatcagagccagacaccggaaacccctgccacaccactaagttgttgcacagagactcagtggacagtgctccaatcctcactgcatttaacagctcacacaaaggacggattaactgtaatagtaacactacacccatagtacatttaaaaggtgatgctaatactttaaaatgtttaagatatagatttaaaaagcattgtacattgtatactgcagtgtcgtctacatggcattggacaggacataatgtaaaacataaaagtgcaattgttacacttacatatgatagtgaatggcaacgtgaccaatttttgtctcaagttaaaataccaaaaactattacagtgtctactggatttatgtctatatgacaaatcttgatactgcatccacaacattactggcgtgctttttgctttgctttgtgtgcttttgtgtgtctgcctattaatacgtccgctgcttttgtctgtgtctacatacacatcattaataatattggtattactattgtggataacagcagcctctgcgtttaggtgttttattgtatatattatatttgtttatataccattatttttaatacatacacatgcacgctttttaattacataatgtatatgtacataatgtaattgttacatataattgttgtataccataacttactattttttcttttttattttcatatataatttttttttttgtttgtttgtttgttttttaataaactgttattacttaacaatgcgacacaaacgttctgcaaaacgcacaaaacgtgcatcggctacccaactttataaaacatgcaaacaggcaggtacatgtccacctgacattatacctaaggttgaaggcaaaactattgctgaacaaatattacaatatggaagtatgggtgtattttttggtgggttaggaattggaacagggtcgggtacaggcggacgcactgggtatattccattgggaacaaggcctcccacagctacagatacacttgctcctgtaagaccccctttaacagtagatcctgtgggcccttctgatccttctatagtttctttagtggaagaaactagttttattgatgctggtgcaccaacatctgtaccttccattcccccagatgtatcaggatttagtattactacttcaactgataccacacctgctatattagatattaataatactgttactactgttactacacataataatcccactttcactgacccatctgtattgcagcctccaacacctgcagaaactggagggcattttacactttcatcatccactattagtacacataattatgaagaaattcctatggatacatttattgttagcacaaaccctaacacagtaactagtagcacacccataccagggtctcgcccagtggcacgcctaggattatatagtcgcacaacacaacaggttaaagttgtagaccctgcttttgtaaccactcccactaaacttattacatatgataatcctgcatatgaaggtatagatgtggataatacattatatttttctagtaatgataatagtattaatatagctccagatcctgactttttggatatagttgctttacataggccagcattaacctctaggcgtactggcattaggtacagtagaattggtaataaacaaacactacgtactcgtagtggaaaatctataggtgctaaggtacattattattatgatttaagtactattgatcctgcagaagaaatagaattacaaactataacaccttctacatatactaccacttcacatgcagcctcacctacttctattaataatggattatatgatatttatgcagatgactttattacagatacttctacaaccccggtaccatctgtaccctctacatctttatcaggttatattcctgcaaatacaacaattccttttggtggtgcatacaatattcctttagtatcaggtcctgatatacccattaatataactgaccaagctccttcattaattcctatagttccagggtctccacaatatacaattattgctgatgcaggtgacttttatttacatcctagttattacatgttacgaaaacgacgtaaacgtttaccatattttttttcagatgtctctttggctgcctagtgaggccactgtctacttgcctcctgtcccagtatctaaggttgtaagcacggatgaatatgttgcacgcacaaacatatattatcatgcaggaacatccagactacttgcagttggacatccctattttcctattaaaaaacctaacaataacaaaatattagttcctaaagtatcaggattacaatacagggtatttagaatacatttacctgaccccaataagtttggttttcctgacacctcattttataatccagatacacagcggctggtttgggcctgtgtaggtgttgaggtaggtcgtggtcagccattaggtgtgggcattagtggccatcctttattaaataaattggatgacacagaaaatgctagtgcttatgcagcaaatgcaggtgtggataatagagaatgtatatctatggattacaaacaaacacaattgtgtttaattggttgcaaaccacctataggggaacactggggcaaaggatccccatgtaccaatgttgcagtaaatccaggtgattgtccaccattagagttaataaacacagttattcaggatggtgatatggttcatactggctttggtgctatggactttactacattacaggctaacaaaagtgaagttccactggatatttgtacatctatttgcaaatatccagattatattaaaatggtgtcagaaccatatggcgacagcttatttttttatttacgaagggaacaaatgtttgttagacatttatttaatagggctggtactgttggtgaaaatgtaccagacgatttatacattaaaggctctgggtctactgcaaatttagccagttcaaattattttcctacacctagtggttctatggttacctctgatgcccaaatattcaataaaccttattggttacaacgagcacagggccacaataatggcatttgttggggtaaccaactatttgttactgttgttgatactacacgcagtacaaatatgtcattatgtgctgccatatctacttcagaaactacatataaaaatactaactttaaggagtacctacgacatggggaggaatatgatttacagtttatttttcaactgtgcaaaataaccttaactgcagacgttatgacatacatacattctatgaattccactattttggaggactggaattttggtctacaacctcccccaggaggcacactagaagatacttataggtttgtaacccaggcaattgcttgtcaaaaacatacacctccagcacctaaagaagatgatccccttaaaaaatacactttttgggaagtaaatttaaaggaaaagttttctgcagacctagatcagtttcctttaggacgcaaatttttactacaagcaggattgaaggccaaaccaaaatttacattaggaaaacgaaaagctacacccaccacctcatctacctctacaactgctaaacgcaaaaaacgtaagctgtaagtattgtatgtatgttgaattagtgttgtttgttgtgtatatgtttgtatgtgcttgtatgtgcttgtaaatattaagttgtatgtgtgtttgtatgtatggtataataaacacgtgtgtatgtgtttttaaatgcttgtgtaactattgtgtcatgcaacataaataaacttattgtttcaacacctactaattgtgttgtggttattcattgtatataaactatatttgctacatcctgtttttgttttatatatactatattttgtagcgccaggcccattttgtagcttcaaccgaattcggttgcatgctttttggcacaaaatgtgtttttttaaatagttctatgtcagcaactatggtttaaacttgtacgtttcctgcttgccatgcgtgccaaatccctgttttcctgacctgcactgcttgccaaccattccattgttttttacactgcactatgtgcaactactgaatcactatgtacattgtgtcatataaaataaatcactatgcgccaacgccttacataccgctgttaggcacatatttttggcttgttttaactaacctaattgcatatttggcataaggtttaaacttctaaggccaactaaatgtcaccctagttcatacatgaactgtgtaaaggttagtcatacattgttcatttgtaaaactgcacatgggtgtgtgcaaaccgattttgggttacacatttacaagcaacttatataataatactaa

SEQ ID NO: 2 - DNA, 7857 bp, Artificial Sequence
  Human papillomavirus type 18 template plasmid (AY262282)
attaatacttttaacaattgtagtatataaaaaagggagtaaccgaaaacggtcgggaccgaaaacggtgtatataaaagatgtgagaaacacaccacaatactatggcgcgctttgaggatccaacacggcgaccctacaagctacctgatctgtgcacggaactgaacacttcactgcaagacatagaaataacctgtgtatattgcaagacagtattggaacttacagaggtatttgaatttgcatttaaagatttatttgtggtgtatagagacagtataccgcatgctgcatgccataaatgtatagatttttattctagaattagagaattaagacattattcagactctgtgtatggagacacattggaaaaactaactaacactgggttatacaatttattaataaggtgcctgcggtgccagaaaccgttgaatccagcagaaaaacttagacaccttaatgaaaaacgacgatttcacaacatagctgggcactatagaggccagtgccattcgtgctgcaaccgagcacgacaggaacgactccaacgacgcagagaaacacaagtataatattaagtatgcatggacctaaggcaacattgcaagacattgtattgcatttagagccccaaaatgaaattccggttgaccttctatgtcacgagcaattaagcgactcagaggaagaaaacgatgaaatagatggagttaatcatcaacatttaccagcccgacgagccgaaccacaacgtcacacaatgttgtgtatgtgttgtaagtgtgaagccagaattgagctagtagtagaaagctcagcagacgaccttcgagcattccagcagctgtttctgaacaccctgtcctttgtgtgtccgtggtgtgcatcccagcagtaagcaacaatggctgatccagaaggtacagacggggagggcacgggttgtaacggctggttttatgtacaagctattgtagacaaaaaaacaggagatgtaatatcagatgacgaggacgaaaatgcaacagacacagggtcggatatggtagattttattgatacacaaggaacattttgtgaacaggcagagctagagacagcacaggcattgttccatgcgcaggaggtccacaatgatgcacaagtgttgcatgttttaaaacgaaagtttgcaggaggcagcacagaaaacagtccattaggggagcggctggaggtggatacagagttaagtccacggttacaagaaatatctttaaatagtgggcagaaaaaggcaaaaaggcggctgtttacaatatcagatagtggctatggctgttctgaagtggaagcaacacagattcaggtaactacaaatggcgaacatggcggcaatgtatgtagtggcggcagtacggaggctatagacaacgggggcacagagggcaacaacagcagtgtagacggtacaagtgacaatagcaatatagaaaatgtaaatccacaatgtaccatagcacaattaaaagacttgttaaaagtaaacaataaacaaggagctatgttagcagtatttaaagacacatatgggctatcatttacagatttagttagaaattttaaaagtgataaaaccacgtgtacagattgggttacagctatatttggagtaaacccaacaatagcagaaggatttaaaacactaatacagccatttatattatatgcccatattcaatgtctagactgtaaatggggagtattaatattagccctgttgcgttacaaatgtggtaagagtagactaacagttgctaaaggtttaagtacgttgttacacgtacctgaaacttgtatgttaattcaaccaccaaaattgcgaagtagtgttgcagcactatattggtatagaacaggaatatcaaatattagtgaagtaatgggagacacacctgagtggatacaaagacttactattatacaacatggaatagatgatagcaattttgatttgtcagaaatggtacaatgggcatttgataatgagctgacagatgaaagcgatatggcatttgaatatgccttattagcagacagcaacagcaatgcagctgcctttttaaaaagcaattgccaagctaaatatttaaaagattgtgccacaatgtgcaaacattataggcgagcccaaaaacgacaaatgaatatgtcacagtggatacgatttagatgttcaaaaatagatgaagggggagattggagaccaatagtgcaattcctgcgataccaacaaatagagtttataacatttttaggagccttaaaatcatttttaaaaggaacccccaaaaaaaattgtttagtattttgtggaccagcaaatacaggaaaatcatattttggaatgagttttatacactttatacaaggagcagtaatatcatttgtgaattccactagtcatttttggttggaaccgttaacagatactaaggtggccatgttagatgatgcaacgaccacgtgttggacatactttgatacctatatgagaaatgcgttagatggcaatccaataagtattgatagaaagcacaaaccattaatacaactaaaatgtcctccaatactactaaccacaaatatacatccagcaaaggataatagatggccatatttagaaagtagaataacagtatttgaatttccaaatgcatttccatttgataaaaatggcaatccagtatatgaaataaatgacaaaaattggaaatgtttttttgaaaggacatggtccagattagatttgcacgaggaagaggaagatgcagacaccgaaggaaaccctttcggaacgtttaagtgcgttgcaggacaaaatcatagaccactatgaaaatgacagtaaagacatagacagccaaatacagtattggcaactaatacgttgggaaaatgcaatattctttgcagcaagggaacatggcatacagacattaaaccaccaggtggtgccagcctataacatttcaaaaagtaaagcacataaagctattgaactgcaaatggccctacaaggccttgcacaaagtgcatacaaaaccgaggattggacactgcaagacacatgcgaggaactatggaatacagaacctactcactgctttaaaaaaggtggccaaacagtacaagtatattttgatggcaacaaagacaattgtatgacctatgtagcatgggacagtgtgtattatatgactgatgcaggaacatgggacaaaacggctacctgtgtaagtcacaggggattgtattatgtaaaggaagggtacaacacgttttatatagaatttaaaagtgaatgtgaaaaatatgggaacacaggtacgtgggaagtacattttgggaataatgtaattgattgtaatgactctatgtgcagtaccagtgacgacacggtatccgctactcagcttgttaaacagctacagcacaccccctcaccgtattccagcaccgtgtccgtgggcaccgcaaagacctacggccagacgtcggctgctacacgacctggacactgtggactcgcggagaagcagcattgtggacctgtcaacccacttctcggtgcagctacacctacaggcaacaacaaaagacggaaactctgtagtggtaacactacgcctataatacatttaaaaggtgacagaaacagtttaaaatgtttacggtacagattgcgaaaacatagcgaccactatagagatatatcatccacctggcattggacaggtgcaggcaatgaaaaaacaggaatactgactgtaacataccatagtgaaacacaaagaacaaaatttttaaatactgttgcaattccagatagtgtacaaatattggtgggatacatgacaatgtaatacatatgctgtagtaccaatatgttatcacttatttttttattttgcttttgtgtatgcatgtatgtgtgctgccatgtcccgcttttgccatctgtctgtatgtgtgcgtatgcatgggtattggtatttgtgtatattgtggtaataacgtcccctgccacagcattcacagtatatgtattttgttttttattgcccatgttactattgcatatacatgctatattgtctttacagtaattgtataggttgttttatacagtgtattgtacattgtatattttgttttataccttttatgctttttgtatttttgtaataaaagtatggtatcccaccgtgccgcacgacgcaaacgggcttcggtaactgacttatataaaacatgtaaacaatctggtacatgtccacctgatgttgttcctaaggtggagggcaccacgttagcagataaaatattgcaatggtcaagccttggtatatttttgggtggacttggcataggtactggcagtggtacagggggtcgtacagggtacattccattgggtgggcgttccaatacagtggtggatgttggtcctacacgtcccccagtggttattgaacctgtgggccccacagacccatctattgttacattaatagaggactccagtgtggttacatcaggtgcacctaggcctacgtttactggcacgtctgggtttgatataacatctgcgggtacaactacacctgcggttttggatatcacaccttcgtctacctctgtgtctatttccacaaccaattttaccaatcctgcattttctgatccgtccattattgaagttccacaaactggggaggtggcaggtaatgtatttgttggtacccctacatctggaacacatgggtatgaggaaatacctttacaaacatttgcttcttctggtacgggggaggaacccattagtagtaccccattgcctactgtgcggcgtgtagcaggtccccgcctttacagtagggcctaccaacaagtgtcagtggctaaccctgagtttcttacacgtccatcctctttaattacatatgacaacccggcctttgagcctgtggacactacattaacatttgatcctcgtagtgatgttcctgattcagattttatggatattatccgtctacataggcctgctttaacatccaggcgtgggactgttcgctttagtagattaggtcaacgggcaactatgtttacccgcagcggtacacaaataggtgctagggttcacttttatcatgatataagtcctattgcaccttccccagaatatattgaactgcagcctttagtatctgccacggaggacaatgacttgtttgatatatatgcagatgacatggaccctgcagtgcctgtaccatcgcgttctactacctcctttgcattttttaaatattcgcccactatatcttctgcctcttcctatagtaatgtaacggtccctttaacctcctcttgggatgtgcctgtatacacgggtcctgatattacattaccatctactacctctgtatggcccattgtatcacccacggcccctgcctctacacagtatattggtatacatggtacacattattatttgtggccattatattattttattcctaagaaacgtaaacgtgttccctatttttttgcagatggctttgtggcggcctagtgacaataccgtatatcttccacctccttctgtggcaagagttgtaaataccgatgattatgtgactcgcacaagcatattttatcatgctggcagctctagattattaactgttggtaatccatattttagggttcctgcaggtggtggcaataagcaggatattcctaaggtttctgcataccaatatagagtatttagggtgcagttacctgacccaaataaatttggtttacctgatactagtatttataatcctgaaacacaacgtttagtgtgggcctgtgctggagtggaaattggccgtggtcagcctttaggtgttggccttagtgggcatccattttataataaattagatgacactgaaagttcccatgccgccacgtctaatgtttctgaggacgttagggacaatgtgtctgtagattataagcagacacagttatgtattttgggctgtgcccctgctattggggaacactgggctaaaggcactgcttgtaaatcgcgtcctttatcacagggcgattgcccccctttagaacttaaaaacacagttttggaagatggtgatatggtagatactggatatggtgccatggactttagtacattgcaagatactaaatgtgaggtaccattggatatttgtcagtctatttgtaaatatcctgattatttacaaatgtctgcagatccttatggggattccatgtttttttgcttacggcgtgagcagctttttgctaggcatttttggaatagagcaggtactatgggtgacactgtgcctcaatccttatatattaaaggcacaggtatgcgtgcttcacctggcagctgtgtgtattctccctctccaagtggctctattgttacctctgactcccagttgtttaataaaccatattggttacataaggcacagggtcataacaatggtgtttgctggcataatcaattatttgttactgtggtagataccactcgcagtaccaatttaacaatatgtgcttctacacagtctcctgtacctgggcaatatgatgctaccaaatttaagcagtatagcagacatgttgaggaatatgatttgcagtttatttttcagttgtgtactattactttaactgcagatgttatgtcctatattcatagtatgaatagcagtattttagaggattggaactttggtgttccccccccgccaactactagtttggtggatacatatcgttttgtacaatctgttgctattacctgtcaaaaggatgctgcaccggctgaaaataaggatccctatgataagttaaagttttggaatgtggatttaaaggaaaagttttctttagacttagatcaatatccccttggacgtaaatttttggttcaggctggattgcgtcgcaagcccaccataggccctcgcaaacgttctgctccatctgccactacgtcttctaaacctgccaagcgtgtgcgtgtacgtgccaggaagtaatatgtgtgtgtgtatatatatatacatctattgttgtgtttgtatgtcctgtgtttgtgtttgttgtatgattgcattgtatggtatgtatggttgttgttgtatgttgtatgttactatatttgttggtatgtggcattaaataaaatatgttttgtggttctgtgtgttatgtggttgcgccctagtgagtaacaactgtatttgtgtttgtggtatgggtgttgcttgttgggctatatattgtcctgtatttcaagttataaaactgcacaccttacagcatccattttatcctacaatcctccattttgctgtgcaaccgatttcggttgcctttggcttatgtctgtggttttctgcacaatacagtacgctggcactattgcaaactttaatcttttgggcactgctcctacatattttgaacaattggcgcgcctctttggcgcatataaggcgcacctggtattagtcattttcctgtccaggtgcgctacaacaattgcttgcataactatatccactccctaagtaataaaactgcttttaggcacatattttagtttgtttttacttaagctaattgcatacttggcttgtacaactactttcatgtccaacattctgtctacccttaacatgaactataatatgactaagctgtgcatacatagtttatgcaaccgaaataggttgggcagcacatactatacttttc

SEQ ID NO: 3 - DNA, 11334 bp, Artificial Sequence
  Human papillomavirus type 26 template plasmid (X74472)
gcctgttgtattttagaacatctatattgtagccattgtgacatacacatagatcgttctgtgctctttataatgtctagtcatggtgcacagtcttttacatatttgcctgacattgctttttaaaaggcagctgcattactatctatgtcagctaactgtgcatatttaaatgcaatttcactatcatctgttatgtcatgatcgaacgcccattgcaccatttttgataaatcaaatgtagcatcatcaaaactatgttctaattgtgtttgtcgtactatccattctggtgtatctccatatgtctcacttatattggacaaccctgttttataaaaatataatgctactgctgtacttcgcaattttggtggttcaattagtaattgcgtttctggcacatttaataacatacataggcagtttttaattgttgttctgttttttgcacatgtaaagcgcactagcattagtactattactccccaattacatgttaaacattgtatatgataatataaacaatattgttgtattaatgatttaatactttctgctacagagcctgccacaccgaatgctgcacacacccaatctgaacagcatgttttgtcacttttaaacacccgtactagttctgcaaaacttacaccatatactgttttaaatttacttaacaatgctgcttttacattactacattttaataattcacatatttgtgtaacactgtttacatgtgtgtctacatcgatatcttccactgaggcatttgaccccccctgactacacacactaggcaacccgccattttcttcatattgtttatctacctgtacgggcgtaagagtttccacttcagtatagccatacccgctgtccggtacactgtccacggctctccttttggcctgtgaattatttacttggtgtgtattctgctgactgtcgctttgctgtctgtgttgatttgttatgtcttgcaacgggctgttctgactacctagtaactttcgttttaaattgcgcactgcctttgtatttgcctgtttttgttgtgcctgaaacaatgcctgggttacctcctgttctgcataatcacttatactactatcatctataaatcctattaggtccgaccctgtatcactactattgtctgtttcatcatctgatattgtgtcccctgtatgtttttccactatagcttctactgaaaaccaccctgtacacccccgcccctcctcatttgtaccttcacagtccattgcaggtttactgtgcagcacactgatggcacaccaaggacacgtcttccattaacatctgctccagcactcgaacgttctgtcgactgctctgcacagctagctgcactatactattacacatacaacattgtgcttcaattctgtaacacacttcttgtccagcttgtctggcctgctggtcacgcatattatctgtttcatcctcatctgagctgtcaaattgttcatagtccaattgttcgtagcagcgtaggtcaatttcgggttgcggcaccagatctagtattacatcttcaatattaattatgtttccatgcattgttctttacacttgtgtttctgtttggcgccttggtctccaacaatttgtacacaaccctttccactgccctgctatttcgtgaaatcgtcgcttttcatccacaattctttgtttttcttctggccccaatggcatttgacatctatgacaccttattaacaaattacataaactttttttagttaaggcttctaatgttgcaccatacacagaacatgtatagcgtctatactctgttatttttgaataaaatattacacatcttttgcatgcagcatacggactcctatctctatatactactcttaggtcacaaattgcaaaattatatacatcagcccattgtaaggtttccttgcaatatacacactgtacctgcaaattttgcaaagtagtattcaagctttcacatagctcatgtagcgttctgggtcgttctctaggatcctcgaacatagctgttttgcacgtagctagccttttacttttatatgtaccggtttcggttgcaaccgttttcggttacacccttttagtaacatataattgttaaaagttattataaagaaacttgcatgcattaacaaaacacatttcggttacatacacacctgtgtttaactatgggttacaacagtatgtgtcagacacatagttggcaaacaaaagtgtatatgttagccaactatgcacttaaaagacctataaaataaaataaaaatatgtgcctaacagcagttttattataatgtaagaaaaagtgcttatgtaagtattgtttaaatatatgtgactaatacaggcgcgccacttatagtgccaaaatggcaagccaagcgtaggaggcaggatgtgttgtctgccaaaggattaactgttcctgcaggatacagcatgaaagttggataaaaactaaaataaggaacgaccgaaaacggttgggacaatagatagtaatagaaaatataaaaagtaaaaatataacactacaaaagtttagtgaaatacatataaaaggtaaacttgtgtaatataataattataagggacaccacctaaggttcctcccattacctcaggggtaaaacaaatgacaaatagtgtagtaaagacatgtaaccatgcatgaagacacattcatactttattaaataacaagtatgcatacaaacaggaaaacacataaccatgcatacatataatacatacatacaaaacacgcctttacattacatacagttgtacacacatacaaacacaccttacataacataccacaaacatatacacacacacaaacatgcggaattatttagtaagtttacgttttttgcgtttggtagaggaagaggtagaagataagggacgtttggtgcctagtttcggccgccgttgtatgccggcctgtaacataaacttacgccctagtggaaattgatccaaatcaatagaaaatttttcttttaaatctacatcccaaaatttaaatttttgaaaaggatcttcctttggcacaggaggggcgttacgctgacaggtagtagcagagtttttaataaacctataggcatcttccaaactagcagtgggaggtaaggttagtccaaaattccaatcctccaatatggaggcattcattaaatgtatgtaagccataacatctgttgtaagtgttattttacacaactgaaatataaattgtaattcatattcttcgccatgtcttataaattgtttataatcagatggtttaaatggagtggatgcagatgctgcagataatgtactaatggtaaggttagtactgcgggtggtatcaacacaggtaacaaacaattgattgccccaacagataccattattatgaccctgtgcacgttgtaaccagtatggcttattaaatagttgtgcatccgaagtaaccatagagccactaggtgtagcagaataaatagaagatgtagggggctccctgcctgattcagcacctttaatatacaaagtggtgggtatagcatccccaacagcccccgccttattataaaaatgtctggcaaataattgttcccggcgaagaaaaaaaaacatgctgtttccatatgtatctgcagacattttaagataatcaggatatttacatgtggattgactaatatcaatgggcacatctgatttggtagcctgtaaggcagtaaaatccatagctccaaagcctgtatcaatcatatcgccatcctcaataatgctggaaattaattctaagggggggcaatccccacgttgtgtctgtgtatttttacatatagtgccaataccccagtgctctcccaagggcggtgtacaacctataatacataactgtgtttgtttattatcaactgaaacattgtccctgttgtcagtgtctgcatttacagtagccaaatgagagttttcggtatcatccaacttattaaacaaaggatgtccactaaggccaatgcctaatggctgtcctctaccaacttcaacaccaacacaggcccacaccaggcgttctgtgtcaggattatataactgtggatcaggcaatccaaatttattaggatcaggtaggtgcactctaaataccctgtactgataggcagataccttaggaatttcggccttttggccagttttaggtatggaaaaatatggatgtcctaatgttaataaacgagagctgcccgcataataatatatgccggtgcgagttacatattcatccgtgttgacaacccgagacacaggggtgggaggaagatataccttgctgtcactagtacgccacaaagccatctcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgaaaaaaaataaggcatacgtttacggcgtttatggattaaataaatatagggccataaataataattatccccatgcacaactattgcaggtaagttagtggtgggtggggggggcaatgatggccatgtcggggaagatgtgggcgtgtaaatgtctgacccactatatacaggtagttcaaatgaggtggataaaggcacagtaacattggtagtggaagtattaatagaggaaaacacattggaggcatatcttggaactggtaatgttgtaggggaatatgacatgcgcggcgtatgtatgctaggaactgtatcagggtctgcatatatatcaaacaaaggtgcagatgaatgggtagatgtatgtaaaggctgcaattcaatttcttcgtgttcagcaaaagactgtataggactaatatcatgataataatgtactgtagctccaatttgttttccactacgtgttttcatagtggccttttgacccaacctactatagcgtacagtacctttgcgagatgtaagggccggacgatgcaatgcaataatgtccaaaaaatcggggtcaggtgctacagtactactggaagcatatgtaagtgtttcatctataggttcatatgcaggattatcaaaggtaacaaatgtggagggattaccaataaaattgggatctgtaacctttacctgttgataggccttactatacaaacgaggagctgacactcgttgtataccaggaataggtgtactactaataggttctaatcctgttccattagtagaagcaaatacttccattggaatttcttcataactatgtgtgccagctgtggacgttgtagtaaatatatgacctgatgcttccccggcctgtggtatatctatagggggttcaatatataatggattttgtatattggtacttgttacatgtacagtaccagcagagggggtgatgtccaacacagcaggtgttgttgcagaggatgtggtaagttcaaagccattgccaccactaaatgtaggtataggggctccagattgtataatactagattcctccaccaaagtaactatagaaggttctgtaggacccacaggttcaataataatgggcggacgggtagggccgatatccacaacagagggtctaccaccccctcctaggggaatgtatccagtacgcccaccagacccagttcctgtacctataccaagaccacctaaaaatattcccaaaccactccattgtaatatcttatcagcaagggtagaaccttcaattttaggaataacatcaggagggcacgtaccagcggccttacatgttttgtataagtctgtagctgatgctcgtttgcgtcgaggggcacggacagctaccattgtaacacgtttattaaagggactaagtagcaattaccattacagtataaaaatgtaaaaaacaagcaggtataaaaaataagcaaatatacacaatataggtagttatatatgatgtagataccacaaaccaaaaacaaaacactaataatagcgaggctgcaaacacataaatggaaagcaaaagtggcaacaaacaacacagcaacacacacacacacacgcaaagcacaaacacataaactataaaaggaataatgattacaggtatataggtgtgttagcagcacatattggcttgtgtgttggtaaaatatacactatattacaatgacattattcccaatgttgaagttatactttgtggtattttaacagttgttaaaaaattattacgttgtgttatactgttaaaggtaattgttacaatgccttgttgattggtatcattactggtccaatgccaggtagatgatacattgcaatacaatcctttatgctttttaaatctatatcttaaacattttaaactatttgtatcaccttttaggtgtactataaacacagtttggtcactactcgtgtcccttcccgggtgatggcctccacttgtactgtgtaggttgttgtttgtatagtccactgactgtccgggctgtgtggcagctgtggtgacagtggtgactgtggtgacggtggtgtcaggtccactgagtcgtcgtcgctttcctgggtatggcgcctcggtttccttggtgcccacgggcacgtaggcttcggtggtctgggtggtggcgtttgatactggctcagcagttttagcagtggatatttggttgctgctgcaggtactagatacaaattcaggacaacagattacctgaccacacacatgtacagcccattgcacacctgtcccatatttttccgcctcttgtttaaagtccacgtaatactgcttatatgccccttgtgtataatatatcccttttgcatcaacatctccagtacctttacaccaccctatatcagttttataatacacatatttccacctaatataatccattgtattttccttattacaatcaaataccactgttaccgttgttccttcttttttaaaacaatgtttaggttctgtcatatacatttcatagcttgtgtctcgcattgtccaagcttctgtattatagtccgtgtttattaacgactgcaatgctatatgtatttcaattgcctgccatgccttttgtttacacacaacagtagagggcaccacctggtggtttatacattgcatgtttccttcacgagctttataaaatattgcacattcatatcgtaccagtttccaataatcaatttgatcagttaatttattactgtccagttcataatagtctagtattttctcctggcacgcatttaaacgctggcaaaggttctccattttctttgtccgcgtcctcctccaaatctaatctggaccaggtggtggaaaaaaagcttttccaatttacatcagtcaatgcatatacaggattcccattgctgtcaaatggaaatgtatttggaaatggtatcactgttactctactatgtaaatacaaaagtgagttatcttcttgaggatttatatttgaggtaattattaatggggggcatgtaacttgcagtaggcttctatgttttctgtctatacaacagggatttccatctaaaaagttacgtaaatatttatcaatatataaccagcagctatatgtagcatcatctaatactgcaacttttgcatcttctaaaggctgcagccaaaaatggctatttgaatttacatatgaaatgactgacccttgcataaattttataaaactcattgcaaactgtgacttaccagtatttggcggtccatatattactatacaattgtgctttggggtaccctttaaaaactgttttaacacttgtaaaaaataaataaagtttacatgttgaaaccttaaaaatttggcaatttccttccacgacccgccctcttctattttagaacatctatattgtagccattgtgacatacacatagatcgtttctgtgctcttttataatgtctagtcatggttgcacagtcttttacatattttgcctgacaattgctttttaaaaaggcagctgcattactatctatgtcagctaactgtgcatatttaaatgcaatttcactatcatctgttatgtcatgatcgaacgcccattgcaccatttttgataaatcaaatgtagcatcatcaaaactatgttctaattgtgtttgtcgtactatccattctggtgtatctccatatgtctcacttatattggacaaccctgttttataaaaatataatgctactgctgtacttcgcaattttggtggttcaattagtaattgcgtttctggcacatttaataacatacataggcagtttttaattgttgttctgttttttgcacatgtaaagcgcactagcattagtactattactccccaattacatgttaacattgtatatgataatataaacaatattgttgtattaatgatttaatactttctgctacagagcctgccacaccgaaa

SEQ ID NO: 4 - DNA, 7912 bp, Artificial Sequence
  Human papillomavirus type 31 template plasmid (JO4353)
taataataataatcttagtataaaaaagtagggagtgaccgaaagtggtgaaccgaaaacggttggtatataaagcacatagtattttgtgcaaacctacagacgccatgttcaaaaatcctgcagaaagacctcggaaattgcatgaactaagctcggcattggaaataccctacgatgaactaagattgaattgtgtctactgcaaaggtcagttaacagaaacagaggtattagattttgcatttacagatttaacaatagtatatagggacgacacaccacacggagtgtgtacaaaatgtttaagattttattcaaaagtaagtgaatttagatggtatagatatagtgtgtatggaacaacattagaaaaattgacaaacaaaggtatatgtgatttgttaattaggtgtataacgtgtcaaagaccgttgtgtccagaagaaaaacaaagacatttggataaaaagaaacgattccacaacataggaggaaggtggacaggacgttgcatagcatgttggagaagacctcgtactgaaacccaagtgtaaacatgcgtggagaaacacctacgttgcaagactatgtgttagatttgcaacctgaggcaactgacctccactgttatgagcaattacccgacagctcagatgaggaggatgtcatagacagtccagctggacaagcagaaccggacacatccaattacaatatcgttaccttttgttgtcagtgtaagtctacacttcgtttgtgtgtacagagcacacaagtagatattcgcatattgcaagagctgttaatgggctcatttggaatcgtgtgccccaactgttctactagactgtaactacaatggctgatccagcaggtacagatggggaggggacgggatgcaatggttggttttatgtagaagcagtaattgacagacagacaggggacaacatttcagaggacgaaaatgaagacagtagtgatactggggaggatatggttgactttattgacaattgtaatgtatacaacaatcaggcagaagcagagacagcacaggcattgtttcatgcacaggaagcggaggaacatgcagaggctgtgcaggttctaaaacgaaagtatgtaggtagtcctttaagtgatattagtagttgtgtggattataatattagtccacggttaaaagctatatgcatagaaaataacagtaaaacagcaaaacgaagactctttgaacttccagacagcgggtatggcaatactgaagtggaaacgcagcagatggtacaggtagaggagcaacaaacaacattaagttgtaatggtagtgacgggacacatagtgaacgagagaatgaaactccaacacgtaatatattgcaagtgttaaaaactagcaatggtaaagctgctatgttaggtaaatttaaagaattatatggtgtaagttttatggaactaattaggccatttcaaagcaataaaagcacatgtactgattggtgtgtagctgcgtttggagttacaggtacagttgcagaaggatttaaaaccctattgcaaccatattgtttgtattgccatttacaaagtttagcatgttcctggggcatggttatgttaatgcttgtgagatttaaatgtgcaaaaaatagaataacaattgaaaaattattagaaaaattattgtgtatatctacaaattgtatgttaattcagccacccaaattacgtagcacagctgcagcattatattggtacagaacaggaatgtcaaacattagcgatgtatatggtgaaacaccagaatggatagaaagacaaacagtattacagcatagttttaatgacacaacatttgatttgtcccaaatggtacaatgggcatatgacaatgatgttatggatgatagtgaaattgcctataaatatgcacaattagctgacagtgatagtaatgcatgtgcatttttaaaaagtaattcgcaggcaaaaatagttaaagattgtggaacaatgtgtagacattataaacgagcagaaaaacgacaaatgtccatgggacagtggattaaaagtagatgtgacaaagttagtgacgaaggtgactggagggacatagtaaagtttttaagatatcaacaaatagaatttgtgtcatttttatctgcattaaagctgtttttaaaaggagtgccaaagaaaaactgtattttaatacatggtgcacctaatacaggtaaatcatattttggaatgagccttattagctttttacaaggatgtataatatcatatgcaaattcaaaaagtcatttttggttacaaccactggctgatgctaaaataggcatgttagatgatgctacaacgccatgttggcattatatagacaattacctacgaaatgcactagatggcaaccctgtatctatagatgtaaagcataaagctttaatgcagttaaaatgtcctcctttattgattacatctaatataaatgcaggtaaggatgacagatggccatacctacatagcagactggtggtttttacatttccaaatccatttccatttgacaaaaacggaaatccagtatatgaattaagtgataaaaactggaaatcctttttctcaaggacgtggtgcagattaaatttgcacgaggaagaggacaaagaaaacgatggagactctttctcaacgtttaaatgtgtgtcaggacaaaatattagaacattatgaaaatgatagtaaacgactttgtgatcatatagactattggaaacatattcgacttgaatgtgtattaatgtataaagcaagagaaatgggaatacacagtattaaccaccaggtggtgccagcgttgtcagtatcaaaggccaaagccttacaagctattgaactacaaatgatgttggaaacattaaataacactgaatacaaaaatgaggactggacaatgcagcaaacaagtcttgaactgtatttaactgcacctacagggtgtttaaaaaaacatggatatactgtagaggtgcaatttgatggtgatgtacacaacaccatgcattatactaactggaaatttatatacctatgtatagatggccaatgtactgttgtggaagggcaagttaattgtaagggcatttattatgtacatgaaggacatataacatattttgtaaattttacagaagaggcaaaaaaatatgggactggtaaaaaatgggaagtgcatgcgggtggtcaggtaattgtttttcctgaatctgtatttagcagtgacgaaatatcctttgctgggattgttacaaagctaccaacagccaacaacaccaccacatcgaattccaaaacctgcgccttgggcaccagtgaaggtgtgcggcgggcgacgacgtctactaagcgaccaagaacagagccagagcacagaaacacccaccaccccaacaagttgttgcgaggcgactccgtggacagtgtcaactgtggggttatcagtgcagctgcatgcacaaaccaaacaagggctgtcagttgtcctgcaactacacctataatacacttaaaaggtgatgcaaatatattaaaatgtttaagatataggctgtcaaaatataaacaattgtatgaacaagtgtcatctacatggcattggacatgtacagatggaaaacataaaaatgctattgtaaccttaacatatataagtacatcacaaagagacgattttttaaatactgtaaaaatacctaacacagtatcagtgtcaacaggatatatgactatttagcctaatgattgaactaaatatttctacagtaagcattgtgctatgctttttgctttgcttttgtgtgctactatttgtgtgtcttgtcatacgtccacttgtgctgtctgtgtcggtatatgcaacactactattattaattgtgattttatgggttattgcaacctctccattacgttgtttttgtatatatgttgtgtttatatatattccattatttgtaattcatacacatgcatcttttttaagtcaacagtaacttttttacttgtgtatactgttgtttgtattggtattggtattggtattggtattggtattggtataataaacttttttactttttttttattattaccatgcggtccaaacgctctacaaaacgcactaaacgtgcgtctgctacacaattatatcaaacatgtaaagcagcaggtacttgtccatcagacgttatacctaaaatagaacatactaccattgcagaccaaatattaaggtatggtagtatgggtgttttttttggtgggttgggtattgggtccggctctggtactgggggtcgcactggatatgtccctcttagtacacgtccttctacagtatctgaggcaagtatacctattagaccaccagttagcattgaccctgtaggtcccttggacccctctatagtaagtcttgttgaagaatctggaattgttgatgttggtgcccctgctcctataccacaccctcctacaacatctgggtttgacattgctacaactgcagacacaacacctgcaattttagatgtaacaagtgttagcacacatgaaaatcctacttttactgatccatctgtattgcagcctcctacacctgcagaaacatcaggtcatttactactttcatcatcatctattagcacacataattatgaggaaatacctatggatacatttattgtttctactaataatgaaaacataacaagtagcacacccattccaggggtgcgccgtcctgcacgtttagggttatatagtaaggctacacaacaagtaaaagttattgatccaacgtttcttagtgctccaaaacagctaattacatatgaaaaccctgcctatgaaactgtaaatgctgaagaatctttatacttttccaatacatcgcataatatagcccctgatcccgactttctagatattatagcattacataggcctgcccttacctcacgtaggaacactgttagatatagtagactaggtaataaacaaactttgcgcactcgtagtggtgctactattggtgcaagggtgcattattattatgatattagtagtattaatcctgcaggtgaaagtattgaaatgcaacctttaggggcgtctgcaactactacttctactttaaatgatggcttatatgacatttatgcagacactgattttactgtggatacacctgccacacataatgtttccccttctactgctgtacagtccacatctgctgtgtctgcctatgtacctacaaataccactgtgccactaagtacaggttttgacattcccatattttctgggcctgatgtacctatagagcatgcacctacacaggttttcccatttcctttggcccctacaacgccacaagtgtctatttttgttgatgggggtgatttttatttgcaccctagttattatatgttaaaacgtcgacgtaaacgtgtatcatatttttttacagatgtctctgtggcggcctagcgaggctactgtctacttaccacctgtcccagtgtctaaagttgtaagcacggatgaatatgtaacacgaaccaacatatattatcacgcaggcagtgctaggctgcttacagtaggccatccatattattccatacctaaatctgacaatcctaaaaaaatagttgtaccaaaggtgtcaggattacaatatagggtatttagggttcgtttaccagatccaaacaaatttggatttcctgatacatctttttataatcctgaaactcaacgcttagtttgggcctgtgttggtttagaggtaggtcgcgggcagccattaggtgtaggtattagtggtcatccattattaaataaatttgatgacactgaaaactctaatagatatgccggtggtcctggcactgataatagggaatgtatatcaatggattataaacaaacacaactgtgtttacttggttgcaaaccacctattggagagcattggggtaaaggtagtccttgtagtaacaatgctattacccctggtgattgtcctccattagaattaaaaaattcagttatacaagatggggatatggttgatacaggctttggagctatggattttactgctttacaagacactaaaagtaatgttcctttggacatttgtaattctatttgtaaatatccagattatcttaaaatggttgctgagccatatggcgatacattatttttttatttacgtagggaacaaatgtttgtaaggcatttttttaatagatcaggcacggttggtgaatcggtccctactgacttatatattaaaggctccggttcaacagctactttagctaacagtacatactttcctacacctagcggctccatggttacttcagatgcacaaatttttaataaaccatattggatgcaacgtgctcagggacacaataatggtatttgttggggcaatcagttatttgttactgtggtagataccacacgtagtaccaatatgtctgtttgtgctgcaattgcaaacagtgatactacatttaaaagtagtaattttaaagagtatttaagacatggtgaggaatttgatttacaatttatatttcagttatgcaaaataacattatctgcagacataatgacatatattcacagtatgaatcctgctattttggaagattggaattttggattgaccacacctccctcaggttctttggaggatacctataggtttgtcacctcacaggccattacatgtcaaaaaactgccccccaaaagcccaaggaagatccatttaaagattatgtattttgggaggttaatttaaaagaaaagttttctgcagatttagatcagtttccactgggtcgcaaatttttattacaggcaggatatagggcacgtcctaaatttaaagcaggtaaacgtagtgcaccctcagcatctaccactacaccagcaaaacgtaaaaaaactaaaaagtaatggatgtgtatgtaatacatgtgtctgtatgtgtatgtgcttgtgctgtattgtatatgtgtgtgtttgtgtgttatatatggtatatgtatgtttatgtatgcgtgtgtacttgtatatatgtatagtatgttatgtgtgtatgtatgctatgtatgttaataaatatgtgtatacctgtgtgtgttgtgtatgttgtccttatatacaccctattagtaacatactattactattttataaactattgttcctacttgttcctacttgttcctgctcctcccaatagtcatgtacttatttctgcctataatttaggtgtcacgccatagtaaaagttgtacacccggtccgttttttgcaactaaagctactccattttgattttatgcagccattttaaatccctaaccgttttcggttgcattgtttaaacatgctagtacaactatgctgatgcagtagttctgcggtttttggtttcctgaatactagtttttgccaacattctggcttgtagtttcctgcctaacacaccttgccaacatataatccagtccaactttgcaattatactatgaatcatgtttgtttaaatacaactgtagttcaactatgtgtcatgcacatatattatattatcctacacaccttaaactgcttttaggcacatattttgtagattatctatatccttgattgcagtgctggcttttgcacatgtttaaactgccaaggttgtgtcatgcattataaataagttgtatgttactcatataattaattgcatataggtattacaccgttttcggttacagttttacaagcaattgttctttttatact

SEQ ID NO: 5 - DNA, 11267 bp, Artificial Sequence
  Human papilloma virus type 33 template plasmid (M12732)
ggggaagaaaatataaaaatgtccagaggcttctgcaggcgctggagggtgtagtacagatggttcagtaaatgtgggatttaaatgtgtagaaatagtttgaatagatgcctccccaacagatgaaacattaataattgcaggtgtagtatctgcagatgtagtaacatcaaaacctgatggtgtaggaatagatggggctggtgcacctgcctctataaaacttgtttcttctattaatgacactatagacgagtctaaaggtccaacagtgtctacagtaaccggaggacgtataggctgcaaggggattgcagctgtaggtgggtcagtaccaataggtacatagccagtccttccacctgaaccagagcctgtgccaatacctaaaccaccaaaaaaaacccctaaactgccatatttaagaatttgatctgctatggtacttccttccactttaggaataacatcgggtgggcaggtgcctgtggccttgcatgtttggtatagttgtgttgcagatgcacgcttgcgccttgtagatcgtttgtgtctcataataatacactgctaaaatataaaggtatttattagtaatacaaaaaaaaaaaaactaaaataacaacaacaatgttaaaacaccaccatgtgcacatatatacaaacaatatatacatgtatatacattactcttgttgtgtcatatgctgtgcatgaaaattaatacacatcattggtaaatataaaaacaacaaatagcaaaaaaaaatttttaaaggagatcccacaaacacccaaagcagcaataccaacaccagcaaccaagcataggtagaaatggaaagtattaaaggacgtaataataaggataagcataaaaacaatataaaacataatacaaaaacaaatatcatggttatatacaattagcagcacatattggcttgtgatgtacacttataatgtcataaatccagtacttatttgcacagtaggtggtatttttacggtacctaaaaacatttgttgttgctgttcagttacaaatgttacagttacaattccatttttactatttttgttgtcactggtccaatgccaggtggatgacatagaactatacaactctttataaggttttaatctgtatcttaaacattttaaactatttgattcaccttttaaatgcactataggtgcaacgttaggactacacacagtccgctgcttgtttgtgcagttagttgcagtacgtgctgttctattgtccaaggcggggtctgcacagaacagctttgtaaggggctgggcggtgtctgtggtgtctgcaggtcgtcgtcgtttggccgctgcttgtggtggtcggttatcgttgtctgtctgtatgtcagcagtttcagtagtggatatttggttgctagatatagacgtaggacaaacaattacctgaccacccacatgtacttcccacatttgtgttttagaatactttgcagcatcctctttaaaatatttaaaatataccttttcacagttatgtatataatacatacctatataatctactttccctgtaaccatagtacatgtatcttcctctataatatatatttcaccccagtttgtataatccattgtattttttttgtcattgtcatattgcacagttactgtttctccttgttttttaaaacattttggtggttcacaaagccacacctctaagcttgtttgttgcaatgtccattggcttgtactatactgtgatttacttaatgtctctaatgccatttgtagttcaattacttgaaatgctttggtctttgatgctaacaaagaaggcaccacctggtggcataaatgtgaaaatcccatttgtttggctgtatacaataaagcacactccatgcgtatcagtttccaatgttcaatttgtgatggtaaatcagttttatcagcttcgtaaagagctagcattttctcctgcactgcatttaaacgtgctgatatttcctccatggttttccttgtcctcttcctctattaaatctaatttgcaccacgtccttgagaaaaaggatttccaattttcatcatttattgcatacactgggttaccattttcatcaaatgggaatggatttttaaattcaaatactgttaatctactatgtaaatatggccatctagagtctgtgcctgcatttgtatttgaggtaagaagcagtggtggacattttaattgcactaatgccctatgtttcacatctattgaaatttcatttccatctaacgcatttctcatgtaatcatctatatatgtccaacttattggcgttacatcatctatcattcctatttttgcatctgataatggctgcaaccaaaagtgacttttagaatttacacatgatataacacacccttttaaaaactgtattaaactcattccaaaatatgactttcctgtatttgctggtccacaaattagcatacagcttttttttggtataccttttaaaaactttttaaatgcacctaaaaatgctgtaaattcaatgttttgatatcttaacaactgtactattggtctccaatttcctccatcatttgttttttcacatctactttgtatccattgtcctattgacattttacgtttttctgcttttttataatgtctacacattattccacagtcctttactatttttgcttgtgagttactttttaaaaatgcagcagcattactatttgaatctgcaagttgtgcataataatatgcaatgtcactatcgtccgttaactcgttatcatatgcccactgtaccatttcacttaaatcaaatatattatcattaaagctatgttgtaaaacagttagtctatctatccattcaggtgttgtaccttgtacatcactaatgtttgacattgctgttctaaaccaatacaatgcacatgtttggctccgtaattttggtggctctataaccatacatgtttcaggtattgataataaattactcattagttttgctactgttaacctgtttttgctacacctaaatctaattaacaataatattattattcctctatcgcaagttaaacattgtaaatgagtatacaaactatgctgtttaattaatacttttaaactttctgctactgatggactaattccatatcctgttatacaccaatctgtacagcttgttttatcacttttaaatggtcttactaattccataaaacttattccataggcctctttaaatttatataatatatttgcttttgtattactactatgtagaacattactaatttcctgcaacgtaacattttcacagctatctacatttgtctcacagcttacttctgaatcatcccccaccccactagattctaagtcatttaagtttgtgtcgccattttgactttctacctgttgtaccatctgctgagtttccacttcagtattgccatatccgctgtcttctagctcatctatttttcgttttctgtatgtgcattctttatttttattaatagacgttctacacgggtttgcagcacgatcaacaacgtcctccgcagcactttgtgaacatgcggcaaactttcgttttagtgcacacacagcatttaaatcatcctccccttcctgtatattaaacaatgcccgggctgcctctgtgtctgcctgtatactattttccatagaatcatctataaactctagtaaatccgtgccactgtcatctgctgtttcatcctcatcttctgaaatattatctcctgttcttctctctatgactgcttctacctcaaaccaaccagtacaccccatcccagccccatttgtaccttcaggatcggccattgtagatgatgtttattgttgtgcacaggtagggcacacaatattcactgtgcccataagtagttgctgtatggttcgtaggtcacttgctgtactgttgacacataaacgaactgtggtgttacaagtgtgacaacaggttacaatgtagtaatcagctgtggctggttgtgcttgtccatctggccggtccaagccttcatcctcatctgagctgtcacttaattgctcatagcagtataggtcagttggttcaggatataaatctaaaacatattcctttaacgttggcttgtgtcctctcatggcgtttttacacgtcacagtgcagtttctctacgtcgggacctccaacacgccgcacagcgccctgcccaacgacccgaaatattatgaaatcgtttgtttaaatccacatgtcgttttttttcttgaggacacaaaggtctttgacatataatacacctaattaatatttcatttaaaggttttttaactgtttgttctaatgtatttccatatacagaataattataatgtctatattcactaattttagataagaaccgcaaacacagtttacatattccaaatggatttccctctctatatacaactgttaaatctgcaaatgcaaaatcatatacctcagatcgttgcaaaggttttttgcattccacgcactgtagttcaatgttgtgtatagttgtctccaatgcttggcacaaatcatgcaatgttcgtggtttttcctcagtgtcttgaaacatagtcgtgcagtaccttactgcaaaatggttgctttatatatgcaccgttttcggttgaaccgctttcggttacaccctacttttttaaaacttggcattatagtttactattatataaaagattataaatgaccaatatgacctaaaacggttagtccacacctggtaataaacaggtagtgactcacttttacaaggcatagtttggcatacaaagcaattgtgtaagccaaaactgcacttaaggtttgaaagtaaagtaaaaatatgtgcctaaaagcatgtgtaaactattagtacaattaagtattttgcaattgcactgcatgtatatatgagtcaatgcagcaagtacagacaaacacagtgcaggaaagaaaaggattaactgttctgccaatgtcatagggtatgtatgccaatgcagcaagtacagacaaacacagtgcaggaaagaaaaggattaactgttctgccaatgtcatagggtatgtatgccaagtaaccgaaaacggttaggcatacaaaatggaggaaattgtacaatatggacactagtatgtcaaaaggtaaagcaatactaaacatgtaggtactacaaatatagggaaataaaggtaggtacattgcaatgcagggtagggcaagcaatacaactccttactcatataggtacacccatatacataacatacatacaaatagtttaacaaatacacacaatgttttattaacatatacacaaacaggaaactgacaagtacatagaacatgcacacaaacaagtacacataaaacaaacacagtaacatacaacataacatacattgtaacacatacacaaaaaacaaacaacaacacaacacaacaacacaaagtacatagacagaacaaaacaacaacataacacaattacacaaagtgttattttttaacctttttgcgttttgcagacgatgtgcgggtggatgtgggggctgcacgtttaagtttaggttttgctttaagacctgcctgtaataaaaacttgcgtcccaaaggaaactgatctaaatctgctgaaaatttttcctttaaatccacttcccaaaatgtatatttacctaaggggtcttccttttcctttggaggtactgttttttgacacgtaatagcctgagaggtaacaaacctataggtatcctgtaaactagcagatggaggaggtgttaaaccaaattgccaatcttctaaaatatctggattcatagcatgaatatatgtcataacttctgcagttaaggtaactttgcatagttgaaaaacaaactgtagatcatattcttcaacatgtcttatatattctttaaaattttcatttttatatgtactgtcactagttacttgtgtgcataaagtcatattagtactgcgagtggtatctaccacagtaacaaatacctgattgccccaacaaataccattattatgaccttgtgcacgttgtagccaatatggcttattaaataactgagattcggaagtaaccattgatccactaggagtgggaaaaaaagcactgctttgaatagaggcagtagttcctgaacctttaatgtacaggtcatcgggaacagcctctcctaatgtaccagccctattaaaaaagtgtcttacaaacatttgttcacgtcgaagaaagaaaaataaactatcaccataaggctcactagtcatttttaaataatctggatatttgcatgtactgccacaaatatcaataggaacatcacttttattagcctgcaatgttttaaaatccatgcaaccaaatcctgtgtccaccatatcaccatcctcaataatagtatttataagttctaaaggtggacaatcattggcaggtgctgcattagtacaagcaacacctttaccccaatgttcccctgttggaggcttacatccaagtaaacataactgtgtttgtttataatccatggataaacattccctattatcagcacccggttgtccaggatacttgttaccggtttcagtgtcatcaaatttgtttaataaaggatgaccacttatgccaacgcctaatggctgccctctacctatttcaaggcctacacatgcccatactaatcgttgtgtatcagggttataaaaggaggtgtcaggaaatccaaatttattaggatctggtaaacggaccctaaaaaccctatattgcaagcctgatactttgggtaccaataattttttagcgttagtaggatttttaatagaaaaatatggatggccaacagcaagaagtctggaactaccagcataataataaatgcttgtgcgagacacatattcatcagtgctgacaactttagatacaggtacaggaggcaggtacactgtggcctcactaggccgccacacggacatctcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgacccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgtaaaaaaatatggaaaacgtttacgcctgcgacgtaaaataaaataactaggatgtaaaacaaagtcagcaccgtctacaacaatggtgtcaaaaggaaaaaaaggcgaaataggaacaaatgggctagatgtgggaaataaaggggaaggtatatcagggccagacataacaggagtatcaaatcctgtatttaaaggtatagacacattgctggtacgtgttgttgcaaacgtactgtatgagtgttgcattggggtgtgtacattatccacatcgtcagcataaacatcatacaaaccatcattaatactataagacgatgtagaagtatcatgtaaaggctgtaattcatattgttcatttggcacggtgtggtctaaaggcacaataggacttaaatcctgataataatgtattctagctccaatttgtttaccactgcgagttttaagtgtggctttttgacctactctactaaaacgcacagtatgtctacgagatgtaatagcaggcctatgtaatgcaataatatctagaaagtcaggatcaggagcaggtgatatatcactatgttgaaattgtaatgtgtcttcagggtcaaagctttcaaatgcaggattatcatatgttataagtttatgaggcgatgttaaaaaagcagggtcaacaaccttaacctgttgggtattgcgactatataaaccaaggcgtgccacagggcgagaccctggaatgggcgtgcttgatgttacattactactgtctgtggaaacaacaaaggtatccattggtatgttttcataactttgtgtgctaacagtaggggaagaaaatataaaatgtccagaggcttctgcaggcgctggagggtgtagtacagatggttcagtaaatgtgggatttaaatgtgtagaaatagtttgaatagatgactccccaacagatgaaacattaataattgcaggtgtagtatctgcagatgtagtaacatcaaaacctgatggtgtaggaatagatggggctggtgcacctgcctctataaaacttgtttcttctattaatgacactatagacgagtctaaaggtccaacagtgtctacagtaaccggaggacgtataggctgcaaggggattgcagctgtaggtgggtcagtaccaataggtacatagccagtccttccacctgaaccagagcctgtgccaatacctaaaccaccaaaaaaaacccctaaactgccatatttaagaatttgatctgctatggtacttccttccacttta

SEQ ID NO: 6 - DNA, 7851 bp, Artificial Sequence
  Human papillomavirus type 35 template plasmid (M74117)
ccctataaaaaaaacagggagtgaccgaaaacggtcgtaccgaaaacggttgccataaaagcagaagtgcacaaaaaagcagaagtggacagacattgtaaggtgcggtatgtttcaggacccagctgaacgaccttacaaactgcatgatttgtgcaacgaggtagaagaaagcatccatgaaatttgtttgaattgtgtatactgcaaacaagaattacagcggagtgaggtatatgactttgcatgctatgatttgtgtatagtatatagagaaggccagccatatggagtatgcatgaaatgtttaaaattttattcaaaaataagtgaatatagatggtatagatatagtgtgtatggagaaacgttagaaaaacaatgcaacaaacagttatgtcatttattaattaggtgtattacatgtcaaaaaccgctgtgtccagttgaaaagcaaagacatttagaagaaaaaaaacgattccataacatcggtggacggtggacaggtcggtgtatgtcctgttggaaaccaacacgtagagaaaccgaggtgtaatcatgcatggagaaataactacattgcaagactatgttttagatttggaacccgaggcaactgacctatactgttatgagcaattgtgtgacagctcagaggaggaggaagatactattgacggtccagctggacaagcaaaaccagacacctccaattataatattgtaacgtcctgttgtaaatgtgaggcgacactacgtctgtgtgtacagagcacacacattgacatacgtaaattggaagatttattaatgggcacatttggaatagtgtgccccggctgttcacagagagcataatctacaatggctgatcctgcaggtacagatgaaggggaggggacgggatgtaatggatggttttttgtagaagcagtagttagtagacgtacgggatccagtgtagaggacgaaaatgaagatgactgtgacaggggggaggatatggtggactttataaatgatacagatatattaaacatacaggcagaaacagagacagcacaagcattatttcatgcacaggaggagcaaacacacaaagaggctgtacaggtcctaaaacgaaagtatgctagtagtccacttagcagcgtgagcttatgtgttaataataacataagtccacgtttaaaagctatttgcattgaaaataaaaatacagcagcaaagcgacgattatttgaactaccagacagcggttatggcaattctgaagtggaaatacacgagatacaacaggtagaggggcatgatacagttgaacaatgtagtatgggcagtggggatagtataacctctagtagcgatgaaagacatgatgagactccaacgcgagacataatacaaatactaaaatgtagtaatgcaaacgcagctatgttggctaaatttaaagaactatttggtattagttttacagaacttattagaccatttaagagtgataaatccacatgtacagattggtgtgtggccgcatttggaatagccccaagtgtggcgaactttaaacatataacatatgtatacatatacaatgtttatcgtgttcatggggctatggtaattctagcattattacgatttaaagtcgaaaaacgagaacaacaattgaaaactattgatgctaaattgctatgtatttcagctgcaagtatgctaatacaaccaccaaaattacgtagtaccccagctgcgttatattggtttaaaacagcaatgtcaaatattagtgaggttgatggagaaacaccagaatggattcaaagacaaacagtattacagcatagttttaatgatgcaatatttgacctatctgaaatggtacaatgggcatatgacaatgattttatagatgatagtgatatagcatataaatatgcacaattggcagaaactaatagtaatgcatgtgcttttttaaaaagtaattcgcaagctaaaattgtaaaagattgtgcaacaatgtgtagacattataaacgagctgaaaaaagagaaatgacaatgtcacagtggattaaaaggcgatgtgcacaggtggacgatgacggtgactggagggacatagtacgatttttaagatatcaacaagtagattttgtggcatttttatctgcactaaaaaattttttacatggtgtgcctaaaaaaaattgcatactaatatatggagcaccaaacacaggtaaatcattatttggaatgagtctaatgcatttcttacaaggagctattatatcctatgtaaattctaaaagccatttttggttgcagccattatatgatgccaaaatagctatgttagatgatgctacatcgccatgtggcatatatagaccaatatttaagaaatgcactagatggaaatcctatatttcatttagatgtaaagcattaagcatagtgcatataatgcccacctttacttattacatcaatataaatgcaggcaaagatgacaggtggccatacttacatagcagggtagtggtctttacatttcacaatgaattcccatttgataaaaatggaaacccagagtatgggcttaatgataaaaactggaaatcctttttctcaaggacgtggtgcagattaaatttgcacgaggaagaggtcaaagaaaatgatggagacgctttcccagcgtttaagtgtgtgtcaggacaaaatactagaacattacgagactgatagcacatgtttgtctgatcacatacagtattggaaactgattcgtcttgaatgtgcagtattttataaagcaagagaaatgggaattaaaactcttaaccaccaagtggttccaacgcaggccatttcaaaagccaaagcaatgcaagcaattgaactgcaattaatgttagagacattaaatacaactgagtatagcacagaggactggacactgcaagaaacaagtattgaactatatacaacagttcctacaagatgtttaaaaaaagatgtttatactgtggaagcacaatttgatggtgataaacaaaatactatgcattatactaattggacacatatatatatattagaggacagtatatgtactgttgtaaagggactggtaaattataaaggtatttattatgtgcatcagggtgtagaaacatattatgttacttttagggaagaggctaaaaagtatggaaaaaaaaatatatgggaagtgcatgtgggtggtcaggtaattgtttgtcctgaatctgtatttagcagcacagaactatccactgctgaaattgctacacagctacacgcctacaacaccaccgagacccataccaaagcctgctccgtgggcaccacagaaacccagaagacaaatcacaaacgacttcgagggggtaccgagctcccctacaaccccaccaagcgagtgcgactcagtgccgtggacagtgttgacagaggggtctactctacatctgactgcacaaacaaagaccggtgtggtagttgtagtacaactacacctatagtacatttaaaaggtgatgcaaatacattaaagtgttcaagatatagattgggtaaatataaagcattgtatcaagatgcttcatctacatggagatggacatgtacaaacgataaaaaacaaatagcaattgtaacattaacttacacaacagaatatcaaagggataaatttttaactacagtaaaaatacctaacacagttacagtgtctaaaggatatatgtctatatgatagaccttacagcttccagtactgtgttgctgtgctttttgttgtgcttttgtgtgcttttgtgcttgtgtctgcttgtacgttcgctattgctatctgtgtcattatactcagcattaatattactggttttaatactgtgggttactgtagcaacaccactacttgcttttgttgtttcttgcttttgtatatacctatggatgattaacgctcatgcacaatatttggcagtacagtaattgtatacaaacattgtgtttggtactgtgtaacatgtgtgtatggtggttttattttttgttgttcattgtatattttgtttttttactgtttttaaacatttttatttctgtgtttttaataaattgatcacatggtataaccatgcgacacaaaaggtctacaaaacgtgttaaacgtgcatctgcaacacaactatatcgtacttgcaaagctgcaggaacttgtccaccagatgttatacctaaggttgagggtaatactgttgctgatcaaattttaaaatatggcagcatggctgtgttttttggggggttaggaattggttctggatctggcacaggtggaagatctggatatgttccactgggtacaacacctccaacggctgccacaaacattcctatacgaccccctgtaactgtggaaagtataccattagacacaattggccctttagattcttctatagtgtcattagtagaggaaactagttttattgagtctggtgcccctgttgttacaccaagggtcccacctacaacaggttttacaataaccacatctacagataccacacctgctattttagatgtgacatccataagtacacatgataatcctactttcactgatccttctgttttacacccacccacgcctgcagaaacttcaggtcattttgtactttcatcatcttctattagtacacataattatgaagaaatccctatggatacttttattgtttccacagacagcaataatataactaatagcacgcctattccagggtctcgccctacgacacgcctaggattatatagtaaaggtacccagcaggttaaggttgttgaccctgcctttatgacttctcctgcaaaacttattacatatgataatcctgcatatgaaggccttaaccctgatacaaccttacaatttgagcatgaggatattagcttagctccggatcctgactttatggacattatagctttacataggcctgcactaacatctaggaaaggcactattagatatagtagagtaggtaataaacgtactatgcatacacgaagtggaaaagctataggggcacgggtacattattatcaggatttaagtagtattactgaagatatagaattacaacccttacaacatgtaccatcctctttaccacataccactgtttcaacatcattaaatgatggtatgtttgatatttatgctcctatagatactgaggaagatattatattttcagcatcttctaacaatactttatatactacatctaacactgcatatgttcctagcaatactactataccattaagtagtggctatgatattcctataacagcagggccagacattgtatttaactctaatactattactaactctgtactaccggtacccacaggtcctatatattctattattgcagatgggggtgacttttatttacaccctagttattatttattaaaacgacgtcgtaaagctatcccatatttttttgcagatgtctctgtggcggtctaacgaagccactgtctacctgcctccagtgtcagtgtctaaggttgttagcactgatgaatatgtaacacgcacaaacatctactatcatgcaggcagttctaggctattagctgtgggtcacccatactatgctattaaaaaacaagattctaataaaatagcagtacccaaggtatctggtttgcaatacagagtatttagagtaaaattaccagatcctaataagtttggatttccagacacatcattttatgatccctgcctccagcgtttggtttgggcctgtacaggagttgaagtaggtcgtggtcagccattaggagtaggtattagtggtcatcctttattaaataaattggatgatactgaaaatcttaataaatatgttggtaactctggtaactctggtacagataacagggaatgcatttctatggattataaacaaacacaattgtgtttaataggttgtaggcctcctataggtgaacattggggaaaaggcacaccttgtaatgctaaccaggtaaaagcaggagaatgtcctcctttggagttactaaacactgtactacaagacggggacatggtagacacaggatttggtgcaatggattttactacattacaagctaataaaagtgatgttcccctagatatatgcagttccatttgcaaatatcctgattatctaaaaatggtttctgagccatatggagatatgttatttttttatttacgtagggagcaaatgtttgttagacatttatttaatagggctggaactgtaggtgaaacagtacctgcagacctatatattaagggtaccactggcacattgcctagtactagttattttcctactcctagtggctctatggtaacctccgatgcacaaatatttaataaaccatattggttgcaacgtgcacaaggccataataatggtatttgttggagtaaccaattgtttgttactgtagttgatacaacccgtagtacaaatatgtctgtgtgttctgctgtgtcttctagtgacagtacatataaaaatgacaattttaaggaatatttaaggcatggtgaagaatatgatttacagtttatttttcagttatgtaaaataacactaacagcagatgttatgacatatattcatagtatgaacccgtccattttagaggattggaattttggccttacaccaccgccttctggtaccttagaggacacatatcgctatgtaacatcacaggctgtaacttgtcaaaaacccagtgcaccaaaacctaaagatgatccattaaaaaattatactttttgggaggttgatttaaaggaaaagttttctgcagacttagatcagtttccgttgggccgtaaatttttgttacaagcaggactaaaggccaggcctaattttagattaggcaggcgtgcagctccagcatctacatctaaaaaatcttctactaaacgtagaaaagtaaaaagttaatgtgtaaatgtgtatgcatgtatactgtgtgttatgtgttgtagtgcttgtatatatattatgtgttgtggtgcctgtttgtgttgtacatggcgtgtaaatgtgtgtataatattgtgcaatgtgttgtacgtgggtgtttttgtacttagtgtgtagtagttcagtagccataaagtgatgtgtgtgtttataattaacactgtattgttgtatgactatggtgcaccgatatgagcttacataattacatgacagctatattgtgtatataaataatctacctccattttgtgtgttagtgtcctttacattacctttcaaccgatttcggttgctgttggtaagctttatatgttttttacaaaaacattcctacctcagcagaacacttaatccttgtgttcctgatatatattgtttgccaactttatattggcttttgccaatctttaaacttgattcatcttgcagtattagtcatttttcatacttgtggtccacccacacttgtaacacttgtaacagtgcttttaggcacatattttttgcatttctaaagggctttaattgcacaccttggctttacatattatgtgtgtttgccaacaccaccctacacatcctgccaactttaagttaaaacatgcatgtaaaacattactcactgtattacacattgttatatgcacacaggtgtgtccaaccgatttggattacagttttataagcatttctttttattatagttagtaacaat

SEQ ID NO: 7 - DNA, 10731 bp, Artificial Sequence
  Human papillomavirus type 39 template plasmid (M62849)
tcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgaaaaaaaatagggaatacgtttccgtttttttaggaaaaaatacaataatggcaacaaataataattggaaccctgaatggttattgcatatgttgtgtctattggtccagaaggcaccaatggcaactgtggagtagtacttggtaaagcaatatcaggaccagtatttacaggcatattccatgaggtactaaaaggaatagttgtattggcatatttagtagatgctgaagaagccacagaaggtagtgagcctgtgttatatgtagtgcccgaatcccttgtattattaaatgcagtatctaaatatgtgttattgtccacatcagcatatatatcaaataatgcatctgaagcatcagagggctcagcgtgaactaggggctgtaattcaatgctttcagcaggagcaatactactaatgtcatggtaataatgtacttgcgctccaatttgtgtgccacgccgggtaaccatggtagcctttttgccaagcctactaaaccttactgttcctttacgcgaggttaaggcaggcctatgtaaacgaacaatgtccagaaaatccggatctggagctatgtcagcagcttcatatgttaatgtagtatcaacaggctcaaaagcaggattatcaaatgttacaaatgatgaagggtgagttacaaaatcaaaattactaacacgaacctgctgatgtgctctactatataaacgtggtcctgccacacgactgattccaggtgtaggtgtgctgctaataggttcggtacctgtgccatgtgtggcaaacacttccataggtatttcctcatagccatgtgtacctgatgtaggggtactgacaaatatattacccgaggtttcacctgtttggggaacctcaattaaggaaggatccgtaaaggcagggttagtataactagtagaggttatttgtacagacccagaggagggtgtaatatccaataccgcaggcgtagtagtagaagaagaagtaatttcaaatccagaggtgcctgtaaatgttggtactggtgttccagaggttataacacttgagtcctccaccaattgcacaatagatggctcagaaggaccaacaggttcaatagctacaggtggacgtgcaggagacacatctacaacagtattaggcctaccccccaggggtatatatcctgtgcgtcccccagtaccagtacctgtgcctatgcctaacccacccaaaaatatacctaaactagtccactgtaaaattttgtcagcaagtgtagtaccctcaactttatcaacaacgtctggtggacaggtacccgattgtttacaggttctatataggtcagttgcagatgcacgcttacgcctggcagcacggtgggaaaccatgtttattagtaacaaaaaaaaatataaaaagctatgtacagtagttatgcacaatgcacatacatatacagtactatatcatatccattgccagtctatgcaacaaccacatgggcaatacaaaaaatagtaaatatacaaaaaacacctccaatggtgtggtacgtataagaataaacacaaacacaattatccacacatacgcacacacatgcacagacggcaaaagcgggacattgcaacatatatatatacacacaccaaaccacaccaaaaataccaataatatcatctatgtagtatgtatacaatatacatacacaatatccatagtatactttacaatgtcatgtaacccaatgaaacatgtacactagaaggtattttaacagtgtccagaaatttttggcgttgtgactctgtggcatatgtaacagttaatatgccagcgtttttggttcccttaccccgtatccaatgccaggtacatgaaatattttcaaacaatgtgtcatatttttgtagtctatatcttaaacattttaaaccatttttgtcaccttttaaatgtattataggcgtagtgttaccacaactgaggtaccgtcttgtgttgtggcctgtactgttactgtggagtgggttgttaagatggtccagggacactccgtcgggctcagtgggctctgtgactgcacactgtcgaggtcgctttcgagacggcggcgggattgttttttgggtgcatggggttgttgcggtggaatgggtcgcggtggtgtttgataattcggtagtaagttcagtagtgggtaccgatccgtcactggtactgcacatagagtccggacaatgaattatgttgccattataatgcacttcccatttgccactagtcccatacctttccgcatcttgaataaacacttcatagtatacttttaggtgctcgttcatataatatataccccaatagtccacacacccttctgttttacaccatatgtctatattatttttataatatatagcaccccataatacatagttcatagcattacatttgtccccatcataccacacctccactgtagttccttgttttttaaaacattgttttggctgtgtatgccacagttcattactagtgtcttttaatgtccactcctctgtattgtattcagtttgtgcaacactttctagtgccatctgcagttcaatagcttgatatgctttacattttgaaatgtttatggttggcaccacctggtggtcaatagtatgcatgccacgttctcgtgctgcataaaatattgcattttccattcgcacacatttccaataattaatttgatcatatattgatttactgtcttgttcatagtattctagtattttgtcctgtaacacatttaaacgttgtgaaagtgttttcatcattgtctccttcatcctcgtcctgctgcaagtctaatctgcaccaagtcttttcaaaaaaacatttccagtttttatcattgattgtgtacactggattcctgttttggtcaaatggaaatgcattaggaaatttaaacactgttagcctactacgtaaatatggccacctatcgtcttccacaggattggtattggaggttattaataatggtggacatttcatttgtagtaaacttttatatttcctatctaaacttattgcatacccatctaatgcatttctcatataattatcgaaatatgaccagcaggtaccggttgcatcatctaacattgctagttttgcatctgcaagtggttctagccaaaagtggctggtggagtttacatatgaaataactgtgccctgtaaaaaatgcataaggctcatacaaaaatgtgactttcctgtattcgcaggcccatatataactatacagttttttttgggagtaccctttaaaaattcctttaatgcacataaaaaggatataaattctattccttgatatcttaagaattgtactatgggtctccagtccccgccttcatcacatttactacacctaaattttatccattgagacatggacatttgccttttttgtgctcgcttgtaatgtttacacattgttgcacaatcttttacatattttgcctggcagttactttttaaaaaggctgcagcattactgttacaatctgctaacattgcataattaaatgctatgtcactttcatcagtatattcattgtcaaatgcccattgtaccatgtccgataggtcaaatacactatcatctattccatgttgtataacagttaatcgttgtatccattctggcgtatcccctgttaccacactaatattggatatacctgtgcgataccaatatagtgctgctacagggctgcgcagtttaggaggctccagaagcatacaactttctggaacatgtaacaatgtacttaatccctttcctacagtaaccctattttttccacatgtatatcttattagcattaaaattagtactccttgttttgtgtctaagctttgtatatgtgtatataaggcatatttgttgattaatgttttaaatccttctgcaatagttggatgtactccaaatatggctgccacccagtctgtacatgttgttttatcacttttaaacgtacgtaccaggtcagtaaaggatagtccatatgtttctttaaattgtgttagcattgcagcctttttgttattggattgtaacaataatttaatttgtgcagttggagatttgggatcctggttttcactatctatagcactatccacactactacactcctcccgtacactgccgccatgttccccttcagcatccccatttgtattagttgctacagttacctcctccacttcagctgtttccacttccatattgccatatccgctgtctggcacggaatacaccgtttgtgttgcctgcgtactgcttacatttaatgaaatttcctgtagtgttcccctggtattcctgcctactttttttccatacggtctagtgtcgccactgctgtctgtatactttcgttttaaggcacgcactgcttgtgcatccctttgggcctcttgcatatgtaaaagtacctgtgctgtctcacgctctgcctgtacacaaatatctgtggaatcatcaataaagtctgccaggtctgaacctgtatctgttgcattttcatcctcatcctccgacactgtgtcgcctgtttgtttatctactattgcctgtactagaaaccatccgttacatcccgacccatccccgtctgtaccttcacgattggccatagcaggttactggtttgcagttgcacaccacggacacacaaatcctagtgagtccataaacagctgctgtagttgtcgcagagtatcccgtgaggcttctactaccagctgcagtgtgttgttacacttacaacacgaacactgtattgtgtgacgctgtggttcatcccgtctggctagtagttgatgttggtgattaactgcatggtcgggttcatctatttcatcctctgactctcctaattgctcgtgacatacaaggtcaaccggctgtatttcattgtaaggacataaatctaatacaatttcctgcaaggtgggctttggtccacgcatatctgatgttatacttgggtttctcttcgtgttagtctgcggtcctcccgttttgtggtccagcaccgtcgacactgtcctgtatagcttcctgctattttatgaaatcttcgtttgctatttaggtgtcttaatttttctgctggacacagcggtttcagacaacacatgcaccttattaataaattatataactttgtattagttatattttctaatgtagttgcatacaccgagtccgagtaatatcgtagctcccgtattttagcataaaattttatacatgattggcatgcagctagtggttccccgtccctatatactacatataaatcactaaatgcaaattcatatacctcggtttgctgtagtggtcgtctgcaatagacacaggctattgtaatgtcctgcaaggtggtgtccagcgttgtgcacaggtctggcaatttgtatggccgttctgcaggattgtgaaatcgcgccatcggtatggacagaaactgtgactgcgttttatatccaccgatttcggtcctgaccgttttcggttactccctttttttaaacaagatacttataaaatgttataagtaaaagtataggtatgtatgcccaacctatttcggttgcataaactattgtgtgctacattagtcacttgtataacttatactgtaagacacattcctgaatcaaaaagtagttatacaggccaactatttaattaagcaagtaaaaacagctaaaatatatgcctaaaagcagttttattacatagggtggagatatggatgttgccaaagtattgttgcagtgcacctggacaggatgatgagtaataaggcgcgccagtaaaactgttaccagtgccaactatgcagggtgaacctaaggtaaagacatgtttttgctgagaaaggtggtttccactagtttaaaaaaaatgctcaacccacgaccgacttcggtcgccacaaaatggcgaagtataaaatgtagaaacgcatacaacaatgtaaaaattacatattaggtagtaaacacaccttagggtagggcatatagattatgtatgaaatgttgcagacctattatatgtaaaacaaatacactgttagtcacagggtgtgcaatcacacatgaaactgtcatacatactttattaacaaaaacatatacacacatacctacaaacatacacatatacactcaacacataaggaaacaaacaacatacacacacataacaaggcatacacatgcattatttagacacacgtttacgtttgtgtttagtagctgaggacgaggaagtggatgcagcaggccgctttcggggacctatagtagggcgcctgcggaccctggcctgcaacaaaaatttacgtcccaaagggaattgatcaagttccaaactaaacttttcccttaagtcaacattccaaaactttagaccgtcatatggatctttcttttcaggtgctggagcatccttttgacatgtaatggctgcagactgtaggtatctgtaagtgtctaccaaactggcagatggtggaggagctacagcaaaattccaattgtccaatatagaggaattcatagtgtgaatataagacataacatcagttgttaatgtgacagtacacagttgaaatataaattgtaaatcatactcctccacgtgcctggtatattccttaaacttagaaggatcatatgtagaaggtatggaagactctatagaggtagataatgtaaagttggtactacgggtagtgtccacaacagtaagaaataattgattatgccaacatataccattgttgtggccctgggccttatgtagccaataaggcttattaaataactgggaatcagaggttaccatggaaccgctgggagaggggcagtatacagaactaccggggtttgcacgtatatctgtgcccttaatatacaattgggcaggaatggcgtcacccaccataccaccacgattccaaaaatgtcttgcaaacagttgttccctacgtaaacagaagaacatactgtccccatacacatctgcagacatttgcaaataatcaggatatttacaaatggattgacaaatatctaaaggcacctcacttttggtttcctgcaatgcaccaaagtccatagctccatagccagtatcaatcatatcaccatcctcaataggggtgtttactagttccaaaggaggacagtcccccgtagatacattattgggcttgcatgcctttcccttaccccagtgctccccaatggcgggaacacagcctataatgcacaactgtgtctgtttataatccacagacacattatccctactgtccttattggtggttgatgaaaatggtgagttttcagtatcatcctgtctattatataatgggtgtccactaataccaacacccaatggctggcccctgcccacctccacccctacacaagcccatactaaacgttgtgtttctggattatataaggatgcatctggaatactgaatttattaggatcgggcaatgtcacgcgaaataccctatattgatatgcagacacctttggaatgtcctgcttgcgaccaccattcatacccactttaaaatatggatgtcctactgttaataatctagagctgccagcataataatatatgcctgtgcgtgtaacataatcatcagtattgacaaccttcgccacagaaggtggaggcaaatacaccatgctgtcactagaccgccacatagccatc

SEQ ID NO: 8 - DNA, 7858 bp, Artificial Sequence
  Human papillomavirus type 45 template plasmid (X74479)
aatacttttaacaattatactacataaaaaagggtgtaaccgaaaacggttgcaaccaaaaacggtgcatataaaagctttgtggaaaagtgcattacaggatggcgcgctttgacgatccaaagcaacgaccctacaagctaccagatttgtgcacagaattgaatacatcactacaagacgtatctattgcctgtgtatattgcaaagcaacattggaacgcacagaggtatatcaatttgcttttaaagatttatgtatagtgtatagagactgtatagcatatgctgcatgccataaatgtatagacttttattccagaattagagaattaagatattattcaaactctgtatatggagagacactggaaaaaataactaatacagagttgtataatttgttaataaggtgcctgcggtgccagaaaccattgaacccagcagaaaaacgtagacaccttaaggacaaacgaagatttcacagcatagctggacagtaccgagggcagtgtaatacatgttgtgaccaggcacggcaagaaagacttcgcagacgtagggaaacacaagtatagcaataagtatgcatggaccccgggaaacactgcaagaaattgtattgcatttggaacctcagaatgaattagatcctgttgacctgttgtgttacgagcaattaagcgagtcagaggaggaaaacgatgaagcagatggagttagtcatgcacaactaccagcccgacgagccgaaccacagcgtcacaaaattttgtgtgtatgttgtaagtgtgacggcagaattgagcttacagtagagagctcggcagaggaccttagaacactacagcagctgtttttgagcaccttgtcctttgtgtgtccgtggtgtgcaactaaccaataatctacaatggcggatccagaaggtaccgacggggagggaacggggtgtaatggctggttctttgtagaaacaattgtagagaaaaaaacaggggatgtaatatcagatgatgaggatgaaactgcaacagatacagggtcggatatggtagattttattgacacacaattatccatttgtgaacaggcagagcaagagacagcacaggcattgttccatgcgcaggaagttcagaatgatgcacaggtgttgcatcttttaaaacgaaagtttgcaggaggcagcaaggaaaacagtccattaggggagcagctaagtgtggatacggatctaagtccacggttacaagaaatttcattaaatagtgggcacaaaaaagcaaaacgacggttgtttacaatatcagatagtggctatggctgttctgaagtggaagctgcagagactcaggtaactgtaaacactaatgcggaaaatggcggcagtgtacatagtacacaaagtagtggtggggatagtagtgacaatgcagaaaatgtagatccgcattgcagtattacagaactaaaggagctattacaagcaagtaacaaaaaggctgcaatgctggcagtatttaaagacatatatgggctgtcatttacggatttggttagaaattttaaaagtgataaaacaacatgtacagattgggtaatggctatatttggagttaatccaacggtagcagaaggctttaaaacattaattaaaccagcaacgttatacgcccatatccaatgtttagattgtaaatggggagtattaatattagctttattaagatataaatgtggcaaaaatagactaactgttgcaaaaggcttaagcacattgttgcacgtacctgaaacatgtatgttaattgaaccaccaaaattgcgaagtagtgttgcagcattatactggtatagaacaggtatatccaatattagtgaagtaagtggagacacacctgagtggatacaaagactgacaattattcaacatggtattgacgatagtaattttgatttgtcagacatggtgcaatgggcatttgataatgaccttacagatgaaagtgatatggcatttcaatatgcccaattagcagactgcaacagtaatgcagctgcatttttaaaaagtaactgccaagccaaatatttaaaagattgtgctgtaatgtgtagacattataaaagagcacaaaaacgccaaatgaatatgtctcaatggattaaatatagatgttccaaaatagatgaaggtggggattggagacccatagtacaattcctaagatatcagggagtagaatttattagctttttaagggcactaaaggaatttcttaaaggaacaccaaaaaaaaattgtatactgttatatggacctgcaaatacaggaaaatcgtattttggaatgagttttatacatttcctacaaggtgcaataatatcatttgtaaattcaaacagccatttttggttagaaccgttagcagatactaaggtagccatgttggatgatgccacacacacgtgttggacatattttgataattatatgagaaatgcattagatggtaatcctataagtatagacagaaagcataaaccattattacagctaaaatgtcctccaatcctattaacatccaatattgatccagcaaaagataataaatggccatatttagaaagtagggtgacggtatttacatttccacatgcatttccatttgataaaaatggtaatccagtatatgaaataaatgataaaaattggaaatgtttttttgaaaggacatggtccagattagatttgcacgaggacgatgaagatgcagacaccgaaggaatccctttcggaacgtttaagtgcgttacaggacaaaatactagaccactatgaaaatgacagtaaagacataaacagccaaataagttattggcaacttatacgtttggaaaatgcaatactatttacagcaagggaacatggtattaccaaactaaaccaccaggtggtgcctcctattaacatttcaaaaagcaaagcacataaagctattgaactgcaaatggccttaaagggccttgcacaaagcaagtataacaatgaggaatggacactgcaagatacatgcgaggaactatggaatacagaaccgtcgcagtgttttaaaaaaggcggtaaaaccgtgcacgtatactttgatggcaacaaggacaactgtatgaactatgtagtatgggacagtatatattatataactgagacagggatatgggacaaaacagcagcatgtgttagctattggggtgtatattatataaaagatggagataccacatattatgtacaatttaaaagcgaatgtgagaaatatggaaatagtaatacgtgggaagtacaatatgggggcaatgtaattgattgtaatgactctatgtgcagtaccagtgacgacacggtatccgctactcagattgttagacagctacaacacgcctccacgtcgacccccaaaaccgcatccgtgggcaccccaaaaccccacatccagacgccggctactaagcgacctagacagtgtggactcacagagcagcaccacggacgtgtcaacacccacgtgcacaacccgctcctgtgttcaagtacaagtaacaacaaaagaaggaaagtgtgtagtggtaacactacgcctataatacacttaaaaggtgacaaaaacagtttgaaatgtttaagatataggctacgcaaatatgcagaccattactcagaaatatcctccacctggcattggacaggttgtaataaaaacactggtatattaactgtaacatataatagtgaggtacaaagaaatacctttttggatgtagttactattcctaacagtgtacaaatctcggtgggatacatgactatatgaatctgtatattgtatacagtatgtaacattactatgctatctttagtgtttttattgtgcttttctgtgtgcctttatgtgtgctgcaatgtcccgcttgtgcagtctgtctatgtgtgtgcttttgcttggttgttggtgtttctttttatagttgttattacatccccattaacagcatttgctgtatacatttgttgctatttactacctatgtttgtattacatatgcatgctttacacaccatacaataattactataatgtacagtacagtgtaacatacctgtgatgtgcatgttgttgtatttttgtatttttgtatttttgtatttttgtattttatatgtttaataaaccatggtatcccaccgtgcagcacgtcgcaagcgggcctctgcaactgacttatatagaacatgtaagcaatccggtacgtgcccccctgatgttattaacaaagtggaaggcacaaccttagctgataaaattttacagtggtctagccttgggatatttttgggtggccttggcattggtaccggcagtggttctggaggccgtacgggctatgtacccttagggggcaggtctaatactgttgtggatgttggccccactaggccacctgtggttattgaacctgtagggcctactgatccatctattgttacgttggtagaggattccagtgttgttgcctctggtgctccggttcccacatttaccggaacctctgggtttgaaattacgtcttctggtactaccacaccagctgtgttggacatcacacctaccgtggactctgtttctatttcgtcaactagttttacaaatcctgcattttctgatccctctattattgaggtgccccaaacaggggaggtatcaggtaatatatttgttggtacaccaacatcgggcagccatggatatgaggaaatacctttacaaacatttgcatcttctgggtcaggtacggaacccattagtagtacccccctccctactgtgcggcgggtacggggtccccgcctgtatagtagggctaatcaacaggtccgtgtgtccacctcacagtttttaacacatccctcatcgttggttacatttgataatccagcttatgagcccctggacaccacactatcctttgagcctaccagtaatgttcctgattccgattttatggatattattcgtttgcataggccagcattatcctctagacgtggcactgttagatttagtagattgggtcaaagggcaaccatgtttacacgtagtggtaaacaaatagggggtagggtacatttttaccatgatataagccccattgctgctacagaggaaattgaattgcagcctttaattagtgctacaaatgatagtgacctgtttgatgtatatgcagacttcccacctcctgcgtccactacacctagcactatacacaaatcatttacatatccaaagtattccttgaccatgccttctactgctgcatcctcttacagtaatgttacagtaccattaacatctgcatgggatgtacctatatatactggcccggacattatattgccatcccatactcctatgtggcctagtacatctcctaccaatgcttccaccaccacctatataggtattcatggcacacaatattatttatggccatggtattattattttcctaaaaaacgtaaacgtattccctatttttttgcagatggctttgtggcggcctagtgacagtacggtatatcttccaccaccttctgtggccagagttgtcagcactgatgattatgtgtctcgcacaagcatattttatcatgcaggcagttcccgattattaactgtaggcaatccatattttagggttgtacctaatggtgcaggtaataaacaggctgttcctaaggtatccgcatatcagtatagggtgtttagagtagctttacccgatcctaataaatttggattacctgattctactatatataatcctgaaacacaacgtttggtttgggcatgtgtaggtatggaaattggtcgtgggcagcctttaggtattggcctaagtggccatccattttataataaattggatgatacagaaagtgctcatgcagctacagctgttattacgcaggatgttagggataatgtgtcagttgattataagcaaacacagctgtgtattttaggttgtgtacctgctattggtgagcactgggccaagggcacactttgtaaacctgcacaattgcaacctggtgactgtcctcctttggaacttaaaaacaccattattgaggatggtgatatggtggatacaggttatggggcaatggattttagtacattgcaggatacaaagtgcgaggttccattagacatttgtcaatccatctgtaaatatccagattatttgcaaatgtctgctgatccctatggggattctatgtttttttgcctacgccgtgaacaactgtttgcaagacatttttggaatagggcaggtgttatgggtgacacagtacctacggacctatatattaaaggcactagcgctaatatgcgtgaaacccctggcagttgtgtgtattccccttctcccagtggctctattattacttctgattctcaattatttaataagccatattggttacataaggcccagggccataacaatggtatttgttggcataatcagttgtttgttactgtagtggacactacccgcagtactaatttaacattatgtgcctctacacaaaatcctgtgccaagtacatatgaccctactaagtttaagcagtatagtagacatgtggaggaatatgatttacagtttatttttcagttgtgcactattactttaactgcagaggttatgtcatatatccatagtatgaatagtagtatattagaaaattggaattttggtgtccctccaccacctactacaagtttggtggatacatatcgttttgtgcaatcagttgctgttacctgtcaaaaggatactacacctccagaaaagcaggatccatatgataaattaaagttttggactgttgacctaaaggaaaaattttcctccgatttggatcaatatccccttggtcgaaagtttttagttcaggctgggttacgtcgtaggcctaccataggacctcgtaagcgtcctgctgcttccacgtctactgcatctactgcatctaggcctgccaaacgtgtacgtatacgtagtaagaaataatatgttagcacatatatgtatgtttgtatgtatggttttgtatgttgtatgtatgtatgtatttgtgtgatatattactgtattttgtttgtttgcgtgcgtgtatgtatgaatgtgccttgtggcatgtatggtgttactgtacataattgtggtattaaataaagtatgctaatagtgttgtgtagggttgcacccttgtgagtaacaatactatttgtgtgtatgtgtattgctttgtaccctatattctttcctgtatttcaagttataaacttgcatactacacagcatccattttacttataatcctccattttgctgtgcaaccgatttcggttgcctgtggcttatatgtgaccttttaaacataatacctaaactggcacatttacaacccctacatagtttaacctactggcgcgccttcttggcgtacatgtggcacacctggtattagtcattttcctgtccaggtgtactaaaacaatggcttgcacaactgtatccacaccctatgtaataaaactgcttttaggcacatattttagtctgtttttacctgtgctaattgtataattggcgtgtagaaccactttcttatccaacaatctgtctacttgttacataaactataaactgactcacttatacatacatagtttatgcaaccgaaaaaggttgggccctataacacataccttttctt

SEQ ID NO: 9 - DNA, 7808 bp, Artificial Sequence
  Human papillomavirus type 51 template plasmid (M62877)
aacaattatcttgtaaaaactagggtgtaaccgaaaagggttatgaccgaaaacggtgcatataaaagtgcagtggtaaaagtatagaagaacaccatgttcgaagacaagagggaaagaccacgaacgctgcatgaattatgtgaagctttgaacgtttctatgcacaatatacaggtagtgtgtgtgtattgtaaaaaggaattatgtagagcagatgtatataatgtagcatttactgaaattaagattgtatatagggataataatccatatgcagtatgcaaacaatgtttactgttttattcaaaaattagagagtatagacgttatagcaggtctgtgtatggtactacattagaggcaattactaaaaaaagcttatatgatttatcgataaggtgtcatagatgtcaaagaccacttgggcctgaagaaaagcaaaaattggtggacgaaaaaaaaaggttccatgaaatagcgggacgttggacggggcaatgcgctaattgctggcaacgtacacgacaacgtaacgaaacccaagtgtaataaagccatgcgtggtaatgtaccacaattaaaagatgtagtattgcatttaacaccacagactgaaattgacttgcaatgctacgagcaatttgacagctcagaggaggaggatgaagtagataatatgcgtgaccagctaccagaaagacgggctggacaggctacgtgttacagaattgaagctccgtgttgcaggtgttcaagtgtagtacaactggcagtggaaagcagtggagacacccttcgcgttgtacagcagatgttaatgggcgaactaagcctggtttgcccgtgttgtgcgaacaactagcaacggcgatggactgtgaaggtacagaggatgagggggcggggtgtaatgggtggttttttgttgaagcaatagtagaaaaaaaaacaggagataatgtttcggatgatgaggatgaaaatgcagatgatacaggatctgatttaataaactttatagatagtgaaactagtatttgcagtcaggcggaacaggagacagcacgggcgttgtttcaggcccaagaattacaggcaaacaaagaggctgtgcatcagttaaaacgaaagtttctagtcagcccgcgaagcagcccattaggagacattacaaatcaaaacaacacacacagccatagtcaggcaaacgagtcacaagttaaaaggagattactggacagttatccggacagcggatatggcaatacacaagtggaaactgtggaagcaacgttgcaggtagatgggcaacatggcggttcacagaacagtgtgtgtagtagcggggggggcagtgttatggatgtggaaacaacagaaagctgtgcaaatgtagaactaaacagtatatgtgaagtattaaaaagcagtaatgcaaaagcaacgttaatggcaaaatttaaagagttgtatggtattagttataatgagttggtacgggtgtttaaaagtgataaaacatgttgtatagattgggtttgtgcattgtttggcgtttccccaatggtagcagaaaatttaaaaacactaattaagccattttgcatgtactaccatatacaatgtttatcatgtgattggggcaccattgtattaatgctaattaggttttcatgtgcaaaaaacagaacaacaattgctaagtgtttaagtacattagtaaatatcccacaatcacaaatgtttatagaaccaccaaaattacgtagtacacctgtggcattatatttttatagaacaggcatatcaaacattagcaatacatatggagagacacctgaatggattacacgacaaacgcaactacaacatagttttgaggatagtacctttgaattatcacaaatggtgcaatgggcatttgaccatgaagtattagatgatagtgaaatagcatttcattatgcacaattagcagatatagatagtaatgctgcagcgtttttaaagagtaattgccaagcaaaatatgtaaaagattgtgggaccatggcacggcattacaaacgagcacaaagaaaatcattatctatgtcagcctggataaggtatagatgtgatagagcaaaggatggaggcaactggagagaaattgctaaatttttaagatatcaaggtgtaaactttatgtcctttattcaaatgtttaaacagtttttaaaaggaacaccaaaacacaattgcatagtcatatatggcccaccaaacacaggcaagtcattatttgcaatgagcctaatgaagtttatgcaagggtccattatttcatatgtaaactctggtagtcatttttggttacagccactagaggatgctaaaatagcattgttagatgatgctacgtatgggtgttggacatatattgatcagtatttaagaaactttttagatggtaatccatgtagtatagatagaaaacataggagtttaatacaattagtatgtccaccattactaataacgtcaaacataaatccacaagaggatgcaaacctaatgtatttacatacaagggtaacagtattaaagtttttaaatacatttccatttgataacaatgggaatgctgtgtatacattgaatgatgaaaattggaaaaattttttttccaccacatggtccagattagatttggaggaggaagaggacaaagaaaatggagaccctatgccaccgtttaaatgtgtgccaggagaaaatactagactgttatgaactggacagtgataaattagtagatcaaattaactattggacattgttacgatatgaagctgctatgttttatgcagcacgggaaagaaacttacgaacaatcaatcaccaggtagtaccagcaacaacagtatcaaaacaaaaggcctgtcaagcaattgaaatgcacatggccttacaatcgcttaacaaatcagactataacatggaaccatggacaatgcgggagacatgttatgaactatggtgtgtggctcccaagcaatgtttcaaaaaggggggcataactgtaacagttatatttgatggaaataaggacaatgcaatggactatacaagctggaaatttatatatatatatgataatgataagtgggtaaagacaaatggaaatgtggactatacgggtatatattacactgtaaattcaaaaaaagaatattatgtacagtttaaagatgaagccaaaatatatggggcacaacagtgggaggtctatatgtatggtactgtaataacatgtcctgaatatgtatctagtacctgcagcgacgcgttatccactactacaactgttgaacaactatcaaacaccccaacgaccaatccccttaccacctgcgtgggcgccaaagaagcccagacacaacagcgaaaacgacagcgacttactgagcccgactcctccacaatctccccactgtccgtggacaatacaaacaaccaaatacactgtggaagtggaagcactaacactggagggcaccaaagtgcaactcagactgcgtttatagtgcatttaaaaggtgatacaaattgtttaaaatgttttagatacagatttacaaaacacaaagggttatataaaaacgtatcctcaacctggcattggaccagtaatactaaaacaggcattgttaccattgtgtttgacagtgcacatcaacgggaaacatttataaaaaccattaaagtacccccaagtgtaacactgtcattgggaattatgacactgtaactagtgtaatatatgtattgtacatatatactgtcacaagccaatatgtgctgctaattgtatagacatattgtaaccattgcagtgtttattattttgctatttgtgctttgcttgtgtgtgtgtcttgtgttgtgttgtttgttgccgctactgctgtcccaatacgtgtttgcagctgccttattattaattttatgtttttggtttgttgttgcaacatcccaattaactacattttttgtatatttgatttttttttacttaccttgtttacttttacatctatatacatttttacttttgcaataaacttgttatatttttgtgattaaatatggtggctacacgtgcacggcgtcggaagcgagcatctgtaacacaattatattctacatgcaaagctgctggtacatgtcctcctgatgttgtgaataaggttgaaggtactacattggccgataaaatattacagtggagtgggttgggtatatttttgggtggcctaggtattggtactgggtctggatctggggggcgtactggatatatccctttaggtggtgggggtcgcccaggcgtggtggatattgctcctgcaaggccacctattataattgacctatggcaccatactgaaccttctatagtaaatttggttgaggactctagtattattcagtctgggtctcctatacctacctttactggtaccgatggctttgaaattacttcatcttccacaacaacccctgctgtgttggacatcaccccatctgctggtactgtacatgtttctagtactaacattgaaaatcctttatatattgaacctccatccattgaggctccacaatctggagaagtgtcagatatatatttactagtacactactctggtactcatgggtatgaagaaatacctatggaagtgtttgcatccaatgtcagtactggtactgaacctattagcagcacacctactccaggggttagtcgcatagctgctccccgcttgtatagtaagtcctacacacaggttaaagttacaaatcctgattttattagtaagccatccacatttgttacatttaataatcctgcttttgagcctattgacacatccataacttttgaggaacctgatgctgttgcacctgatcctgattttctggatattattacactgcaccgccctgcccttacatctcgtagaggcacagtacgctttagtaggttaggtcaaaaggccaccatgcgcactcgtagtggcaaacaaattggtgctcgtgtacattattatcatgatattagtagaattgcaccagctgatgaacttgaaatgcagcctttactttcaccttctaataattatagttatgacatttatgctgatttagatgaagctgaaacaggttttatacagcccacacacaccacacctatgtcacactcctctttgtctaggcagttgccctccttatcttcatctatgtcttcatcttatgcaaatgttactattccattttcaactacatattctgttcctattcatacagggcctgatgtggtattgcccacatctcctacagtatggccttatgttccccacacttccattgacaccaagcattctattgttatactaggtggggattactatttgtggccctatacacatttactacgcaaacgccgtaaacgtataccctatttttttacagatggcattgtggcgcactaatgacagcaaggtgtatttgccacctgcacctgtgtctcgaattgtgaatacagaagaatatatcacacgcaccggcatatattactatgcaggcagttccagactaataacattaggacatccctattttccaatacctaaaacctcaacgcgtgctgctattcctaaagtatctgcatttcaatacagggtatttagggtacagttaccagatcctaacaagtttggactcccggatccaaatttatataatccagacacagataggttggtgtggggttgtgtgggcgttgaggtgggcagaggacagccccttggtgttggccttagtggtcatcccttatttaataaatatgatgacacagaaaattcacgcatagcaaatggcaatgcacaacaagatgttagagataacacatctgttgacaacaaacagactcagttatgtataataggctgtgctccacctattggggaacactggggtattggcactacatgcaaaaacacacctgtacctccaggagactgcccccccctggaacttgtatcctctgtcattcaggatggcgatatgattgatacagggtttggagctatggatttcgctgccctacaggccaccaaatcagacgtccctttggatatttcacagtctgtttgtaaatatcctgattatttaaaaatgtctgcagacacatatggtaattccatgttttttcatttacgcagggagcaaatctttgctaggcactattataataaacttgtaggtgttggggaagacattcctaacgattattatattaagggtagtggtaatggccgtgaccctatagaaagttatatatactctgctactcccagtgggtctatgataacatctgattctcaaatttttaataagccttattggctccaccgtgcgcagggtcacaataatggcatttgctggaacaatcagctttttattacctgtgttgatactaccagaagtacaaatttaactattagcactgccactgctgcggtttccccaacatttactccaagtaactttaagcaatatattaggcatggggaagagtatgaattgcaatttatttttcaattatgtaaaattactttaactacagaggtaatggcttatttacacacaatggatcctaccattcttgaacagtggaattttggattaacattacctccgtctgctagtttggaggatgcatataggtttgttagaaatgcagctactagctgtcaaaaggacacccctccacaggctaagccagatcctttggccaaatataaattttgggatgttgatttaaaggaacgattttctttagatttagaccaatttgcattgggtcgcaagtttttgttgcaggttggcgtacaacgcaagcccagaccaggccttaaacgcccggcctcatcggcatcctcttcctcttcctcttcagccaaacgtaaacgtgttaaaaagtaatgtatgttagtttttgtatgcttgtgcacactgttgtatgcctgtatgtatatgtttgtgtatgtactgtatgtgtttttgtgtgtgtgtgtgttgttgttcctgtatgtatgagttatgtatgtttattattaataaactatgtggtgtgtgtgtgtgtgtttttgcatgactgcatttgtatgacatgtacgggtgtatgtgggtattacattatccccgtaggtcaagggtggtgtttcggtggcgtccctattgccctacccattttttgcagcacaacagtttatatttgtgctatttagttatactttgtagcttccattttgttacagctgcagccattttgagtgcaaccgatttcggttcgtgtacttttagtatatttgccaagttttaaaccacaactgccagttgtttttggcataaaccatcatttttttatgacatagtgcatacatccgcccgcccacgccttgtacttggcgcgccttaccggcgctagtcatacaacctattagtcatttgtactttaacaattgttggcacactgttttccgccctataataatttaactgcttataggcatgtattttttggcatattttatcttactaattgcatagttggcaggtcaaatactatgtttttagtgccaagtttctatcctacttataaaccatcttactcatatgcaggtgtgctacacaaatgtgttacctaaccgatttgtgttctgcctatgcttgcaacattttttcttataacattt

SEQ ID NO: 10 - DNA, 11263 bp, Artificial Sequence
  Human papillomavirus type 52 template plasmid (X74481)
gattttcgtttaatccacctcccaaaacatatagtcctttaaaggatcttcctttcctttaggtggtgtgtttttttgacaagttatagcagtagaagtgacaaatctgtatgtgtcctccaaagatgcagacggtggtggggtaaggccaaattgccagtcctctaaaatagtggcatccatcttatgaatgtatgtcataacatcagctgttaatgtaattttgcacaattgaaaaataaattgtaaatcaaattcctcgccatgacgaaggtattccttaaaattttcatttttatatgtgctttcctttttaacctcagcacataaagtcatgttagtgctacgagtggtatccacaactgtgacaaacaactgattgccccaacatatgccattattgtggccctgcgcacgttgtaaccagtacggtttattaaataattgggattctgaggttaccatagaaccactaggagtaggaaaaaaagcactgctttgtacagtggcagtattgccagagttagacccttgtatatataaatcacctggcacagggtcacctaaggtaccggccctattaaaaaagtgtctaacaaacatttgctcacgtctaagaaaaaagaacaaactgtcaccatatggctcgctagccatttgcaaataatctggatacttacatacactgctacatatatcaatgggcacatcacttttactagcttgcaaggtattaaaatccatgcaaccaaatcctgtatctaccatgtccccatcctgtattacactgttaatgagctgtaggggaggacaatccccaggatttcctgaattattattacaaggggttcccttaccccaatgttcacctataggaggtttgcatcctaaaatgcataactgagtctgcttataatccatagataaacattccctattatctataccaggtttaccagcatatttgttactggtttcagtatcatcaaacttgtttaataaaggatgcccactaatacccacacctaaaggctgtcccctaccaatttccaagcctgtacaggcccacaccaacctttgggtttctgggttataaaaagatgtatctggaaaaccaaatttattagggtccggcaatttaattctaaataccctgtattgcaggccagacaccttgggaactaaaacttttttaccattaccactactggtgtttttaatagaaaaatagggatgtcctactgttagtaatcgagaactgcctgcataataatagatgcttgtgcgagacacatactcatcagtgcttacaaccttagagacaggtacaggaggcaggtacacagtggcctcactaggccgccacacggacatctcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgtaaaaaaatatggaaaacgtttacgcctgcgacgtagtaaaaaataactaggatgtaaaataaaatctgtaccatcaacaataatagatgtagatggagctgtaggggctataggaacaaaaggagtatgtgtgggtaacgaaggtaatggaatgtcaggacctgactcaatggacatagtgggttgatatacaaagtcaataccactattaataggtacagtgaaagtattattatgggtagaaagtgtggaaggtaagtgaaacgtgggttgctgcaaagaatctgcatacacatcatacaaaccatcattaatagtgtaaggggacacagactgtggtaataaaggttgcaattctatgtcttcctgaacttcagcaggctggataggactaatatcatgataataatgtacccgtgccccaatttgttttccactacgtgtacgtagggtggccttattaccaagcctgctaaacctaacagtacctcttcgagaggttaatgcaggcctatgcaaagctataatgtctaaaaaatcaggatccggtgcaggtaaaagttgtgaacgatcaaaaattatagtttcatctgtatcaacgccctcaaaaacaggattgttatatgttactaatttctgtggtgatgacataaaagcagggtcgactaccttaacctgttgtgtggcacggctatataaaccaaggcgtgtcgtagggcgagaccctggaataggtgtactacttgttacactgctgctgtcagtagaggtaacaaatgtatccatagggatttcttcataggtgtgtgtactaatagttggactagaaaacaatacatgaccagatgcttctgcaggtgccgggggctgtattatagatggttcagtgaatgtaggatttaaatgtgtagaaactgattgtacagatgattcacctatagatgttacattaattattgcaggagtattatttgcagatgttgtaacatcaaaccctgttgctgatggaatagatggagcaggtgcgccagactcaataaatgttgtttcttctatcatagaaactatagatggttctaagggaccaatgggttctacagttacagggggacgaatggtggacgtggtaatactactagtgggaggacgagtggacaatggcacatagcctgccctaccaccagagcctgcacctgtacctatacccaaacctccaaaaaacacccctaggctgccatattttaaaagttgatctgcaatagttgtgccttccactttaggaataacatcgggggggcaggtgccagaggctttgcatgtttgatatagctgtgttgcagaagcacgtttgtgccgtgtagaccgtctgtatctcattgcgacaagctattaaaaaatataaaagtatttattagacaaactacaaaagtgaaaaagtatattttgcatatatgcatgtagccaatctacatgtacagttattgcagttgtgccaaatactgtgcatgacagtgaatacaaaacattggaaaatataaaaacagtaggtacaaaaaaaacactttaaatggtgacccaatagatacccatagcaaaagcaccagcaccaacacctgcgcatacaccgatatagatagcaagagcggcctaagcactgcacaaaacaccataagcaaaataaaacaaaatacaaataatcctaacattgttatatatacacaatagcagcaatattggcttgtgttgggtgtttaccatacacatatacatatatacatatgtacaaatatcacaatgacatgacaccttgtataacttgcacagtatttggtattttaacagtttttaaaaattgttgacgttgtgtttcatcactgtacgttattgttacaatacctagtttattatttgtacattcattactggtccaatgccaggtagatgaaatttgaacatacaaacttttatgtgtttttaccctatatcttaaacattttaaactattaggatcaccttttaggtgtattataggtgcagtacaagttgtatgtgcaacccgtcctttgtttgtgcactcagttgcagtgacgagtccccgtgtagtactgtccacggattgttgtccccgcaaaaggttgttggggtacttggtgtttctggagtctgtgacgtctggtcgtcgtcgtttctgtggtggttgtaggtgtgtgtctttggcacccacggacactgcggaggtcttggaggtttcggtgcataggtggacagcagtttcagtagtggatacttcgttactagatacagatgcaggacaaacaattacctgaccacccacatgtacttcccatactcctgttacacaatattgctttgcatcgttactaaattttacaaaatatattttttctccatcacaccaataatataacccatagtaatctacttgtccttctacaattgtacattcacactcaccaagtaaataaatttccttccagtttgtataatccatagtattgttttatcattatcgtattgcactgttattgtatacccatgttttttaaagtatttttgtggttctgcacgccacatttctagacttgtttgttgtaatgtccatccatctgtgctatattgtgttttgtttaatgcctccaatgccaattgtagttcaatagcttggcaggcctttgccttagacactgccattggtggcaccacctggtggcctatatgagttattcccagttcctttgctttgtaaaacaaaacacattccattcgagtcaatttccaatgttcaatttgtgcgtttaggtcattactatcagcttcgtatagatctagtattttttcctgcactgcatttaaacgtgccggtatcgactccatcgttttccttgtcctcttcctgtattaaatctaatttgcaccacgtccttgagaaaaaggatttccaattttcgttgttaatttcatatataggattgccattttcatcaaatggaaatgggtttttgaaatgaaacacaaccaatctactatgtaaatatggccacctaggatctgttcctgcatttgtatttgttgttaaaattaatggtgggcattttatttgtactaaggctctatgctttacatctactgatatatcatttccatccagtgcatttctcatataatcatctatatatgtccaacatataggtgttacatcatctatcatacccacttttgcatctgttaatggttgtagccaaaaatggctttttgagtttacataggatattacacatccacttaagaacctaattaaactcattccaaaatatgattttcctgtgtttgcaggtccatataatactaaacaattttttttaggtataccttttaaaaattttttaaatgcgtctaaaaaggctgtaaattctatgtcttgatatcttaaaaatcttactataggcctccaatctccaccatcatctattctatcacatctatactgtatccattgtccaatattcatatgttttctttctgcccgtttataatgtctacacatggttgcacagtcctttactatttttgcttgcgaattgctttttaggaatgctgcagcattgctatttacatctgctaactgtgcatatttatatgctatgtcactatcatctgttatatcatgatcatatgcccattgcaccatttctccaaaatcgaatatgctattgtcaaagctatgctgtaatactgtttgttgttctatccattctggggtggtaccatatacctcactaatattagacaaacctgttctataccaatataatgcacaggtagcacttcgtaattttggtggttctattaccatatgtgtttctggtatatttaacagctgtgacattagtttggacactgttaatctgttttttccacatttaaacctaattagcagcagtataagcacgcctctgtcacatgttaaacattgcaaatgggcatatatgctatagggctgtattaatacttttaatccttctgcaactgatggtgttactcccattcctataatacaccaatctgtacaactacttctattacttttaaatggtcttactaattccataaagctaacaccatatgtttctttaaatttaaataatacagttgtttttatgctattttcgcacataatattttgtatgctttttagcgttctattactattttcctcattgtcctctatactagtacaacttacatctgaattactagcccccaccccacttgattgactactgttactttgccagtcgccattttgcccgtctacctggtctgccatctgctgcgcttccacttcactattgccatagccgctgtcttctacgtgacatggtttgcgttttggtaaaacacactctgtatttacacaaatgtgttttgcacgcggactaccatgtttttctacaccatcttgcccagcactttccggactgcttgtaaactttcgttttactgcagacacagcatgtaaatcatcctccccttcctgtgcattaaacaatgcccgggctgcctcatgttctgcctgttcattatttatatttgaatcatctataaaatctattagatctgttccactatcatatgcattttcatcctcgtcctctgaaatgttatctcctgtttgtttttctattattgcctctacttcaaaccagcctgtacatccctccctttcgccctctgtaccttcagggtcctccattgcagggttgtttatagccgtgcacagccggggcacacaacttgtaatgtgcccaacagcatttgctgtagagtacgaaggtccgtcgcagtgctatgaatgcatagccgtagtgtgctatcacaactgtgacaatatgtcacaatgtagtaattgcttgtggcttgttctgcttgtccatctggccggtccacaccatctgtatcctcctcatctgagctgtcacctaattgctcatagcagtgtaggtcagttgtttcaggttgcagatctaatatataatcttttatagttgctttgtctccacgcatgacgttacacttgggtcacaggtcggggtctccaacactctgaacagcgccctgtccaacgacccataatattatgaaatcgcttgtttgcattaacatgtctttctttttcttcaggacataatggcgtttgacaaattatacatctaatagttatttcacttaatggtttttttaccctctcttctaatgttttcccatacagtgaatattgataatgcctatattcacttatcttagataaaaagcgtaggcacataatacacacgccatatggattattgtctctatatactattcgtaaatctgtaaatagaaacttgtatacctctcttcgttgtagctcttttttgcactgcacacactgcagccttatttcatgcaccgattcttccagcacctcacacaattcgtgcagggtccggggtcgtgttgctggatcctcaaacatggccgtgcgttagctacactgtgttctatatatatacaccggtttcggtctgaccgttttcggttacaccctattttttactagtataagattataatttataattataaaaaaaagtggttgtgggtacggtaaccgtaaccggtcgtgtagtgcacacctggtgagtaacagtatttaatcatgttttacaagacatatttggcgtaggatgtacttgtgtaagccaacactgtaattagtgcattgaaagtttaaataaaatatgtgcctaaaagcagtttaaaacatgcaatgttaggcaatgtattgtttagctgcactgcaggacctgtgagtcagcaagaagtcagtttaggcgggacaacaagtgtagaccagtggactgcaggaaaccaaaggattaagcagtttgctgaaacttatataaaaatagttgttactgtgccaaggacaaccaaagttgtgccaagaccaaccgaattcggttaggatttaaaatggtggatagtacaaaatggtacaaaatggagagtataaggctaattagtagtgtaacaaagtaggacacagggtagggcaggggacacagggtagggcaggagatgcaatagattaggagcaactgtattgttactcatgtgggtgcaaccataacataagactactataaatagtttagtaaatacagtactttattaatacatacacaaaacatacatacaggaactgacaaatacaacaaacatgcacacacatacataacatgcaaacaacacagtacacacacaaaacaattacataacaaacaatggttaccttttaacctgtgtttgacatacacaacacatacatgacacagacaattacccaacagacaatggttaccttttaacctttttcttctttgtggaggtacgtggggccgatgatgcagggcgttttagtttgggcctagcctgtagccctgcctgtaacaaaaacttcctacctaaaggaaactgatctaaatctgcagaaaacttttcttttaaatccacctcccaaaacatatagtcctttaaaggatcttcctttcctttaggtggtgtgtttttttgacaagttatagcagtagaagtgacaaatctgtatgtgtcctccaaagatgcagacggtggtggggtaaggccaaattgccagtcctctaaaatagtggcatccatcttatgaatgtatgtcataacatcagctgttaatgtaattttgcacaattgaaaaataattgtaaatcaaattcctcgccatgacgaaggtattccttaaaattttcatttttatatgtgctttcctttttaacctcagcacataaagtcatgttagtgctacgagtggtatccacaactgtgacaaacaactgattgccccaacatatgccattattgtggccctgcgcacgttgtaaccagtac

SEQ ID NO: 11 - DNA, 10730 bp, Artificial Sequence
  Human papillomavirus type 56 template plasmid (X74483)
tcctttgcattatggcctgtgtatttttttagacgtaggcgccgtaaacgtattccctatttttttgcaggcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtaccgggccccccctcgagatggcgacgtggcggcctagtgaaaataaggtgtatctacctccaacacctgtttcaaaggttgtggcaacggattcctatgtaaaacgcactagtatattttatcatgcaggcagttcacgattgcttgccgtaggacatccctattactctgtgactaaggacaataccaaaacaaacattcccaaagttagtgcatatcaatatagggtatttagggtacggttgcccgaccctaataagtttgggcttccagatactaatatttataatccggaccaggaacggttagtgtgggcatgtgtaggtttggaggtaggccgcggacagcctttaggtgctgggctaagtggccatccattgtttaataggctggatgatactgaaagttccaatttagcaaataataatgttatagaagatagtagggacaatatatcagttgatggcaagcaaacacagttgtgtattgttggatgtactcccgctatgggtgaacattggactaaaggtgctgtgtgtaagtccacacaagttaccacaggggactgcccgcctcttgcattaattaatacacctatagaggatggggacatgatagacacaggatttggcgctatggactttaaggtgttgcaggaatctaaggctgaggtacctttagacattgtacaatccacctgtaaatatcctgactatttaaaaatgtctgcagatgcctatggtgattctatgtggttttacttacgcagggaacaattatttgccagacattattttaatagggctggtaaagttggggaaacaatacctgcagagttatatttaaagggtagcaatggtagagaaccccctccgagttctgtatatgttgctacgcctagtgggtctatgattacgtctgaggcacagttatttaataaaccttattggttgcaacgtgcccaaggccataataatggcatttgctggggtaatcaattatttgttactgtagtagatactactagaagtactaacatgactattagtactgctacagaacagttaagtaaatatgatgcacgaaaaattaatcagtaccttagacatgtggaggaatatgaattacaatttgtttttcaattatgcaaaattactttgtctgcagaggttatggcatatttacataatatgaatgctaacctactggaggactggaatattgggttatccccgccagtggccaccagcctagaagataaatatagatatgttagaagcacagctataacatgtcaacgggaacagccaccaacagaaaaacaggacccattagctaaatataaattttgggatgttaacttacaggacagtttttctacagacctggatcaatttccactgggtagaaaatttttaatgcaactgggcactaggtcaaagcctgctgtagctacctctaaaaagcgatctgctcctacctccacctctacaccagcaaaacgtaaaaggcggtagtgtgttgttgtgtgtttgtgtaactgtgtttgtgtgttgtatatatggtatgtttgtgtatgtgctttattttatactttgtatgtgtatgttgtgtttgtgtgaaatgtttgtgtgtgtattcattgtatgtatgactgtatatatgtgtaatgtttgtgtgtctgtaataaacatgaatgagtgcttttacgcgtggttgcataaactaaggtgtgtcattattgtggcttttgttttgtaagttattgtgtacagtgtactatgtgtattgtgcatacatatatataccataacatactccattttgttgtttttccgccattttgtacatgcaaccgaattcggttgcatggcctagtgccattatttaaactaaaaggaattcggttgcatggcctagtgccattatttaaaccaaaaggcccttttcagcagaacagttaatcctttggcatattgccgtttcctgtgttttatacttgaattatgtacagtaccgcaccctgtattactcacaggtactatgactgccaactatgcttttatctgcatactttagtgctgttgggcacacatttttatacatgtgtctgcaactttggtgttttggcttgcagaatacactatgtaggccaagtatctgtcagtatctgttttgcaaacatgtaacatacaattactcattttttaaaaccgtttacggtcgtgcaaaaacaggtttcttttaattgttgaaagtttcaatcatacttttatatattgggagtgaccgaaaagggtttaagaccgaaaacggtacatataaaaggcagcttattctgtgtggacatatccatggagccacaattcaacaatccacaggaacgtccacgaagcctgcaccacttgagtgaggtattagaaatacctttaattgatcttagattatcatgtgtatattgcaaaaaagaactaacacgtgctgaggtatataattttgcatgcactgaattaaaattagtgtatagggatgattttccttatgcagtgtgcagagtatgtttattgttttatagtaaagttagaaaatataggtattatgactattcagtgtatggagctacactagaaagtataactaaaaaacagttatgtgatttattaataaggtgctacagatgtcaaagtccgttaactccggaggaaaagcaattgcattgtgacagaaaaagacgatttcatctaatagcacatggttggaccgggtcatgtttggggtgctggagacaaacatctagagaacctagagaatctacagtataatcatgcatggtaaagtaccaacgctgcaagacgttgtattagaactaacacctcaaacagaaattgacctacagtgcaatgagcaattggacagctcagaggatgaggatgaggatgaagtagaccatttgcaggagcggccacagcaagctagacaagctaaacaacatacgtgttacctaatacacgtaccttgttgtgagtgtaagtttgtggtgcagttggacattcagagtaccaaagaggacctgcgtgttgtacaacagctgcttatgggtgcgttaacagtaacgtgcccactctgcgcatcaagtaactaactgcaatggcgtcacctgaaggtacagatggggaggggaagggatgttgtggatggtttgaagtagaggcaattgtagaaaaaaaaacaggagataaaatatcagatgatgaaagtgacgaggaggatgaaatagatacagatttagatggatttatagacgattcatatatacaaaatatacaggcagacgcagaaacagtcaacaattgttgcaagtacaaacagcacatgcagataaacagacgttgcaaaaactaaaacgaaagtatatagctagtccattaagggatattagtaatcagcaaactgtgtgccgggaaggagtaaaacggaggcttattttatcagacctacaagacagcgggtatggcaatacattggaaactctggaaacaccagaacaggtagatgaagaggtacagggacgtgggtgcgggaatacacaaaatggaggctcacaaaacagtacctatagtaacaatagtgaggactctgtaatacatatggatattgatagaaacaatgaaacgccaacacaacaattgcaggacttgtttaaaagtagcaatttacaaggtaaattatattataaatttaaagaagtgtatggtattccattttcagaattggtgcgtacgtttaaaagtgatagtacatgttgcaatgattggatatgtgctatatttggtgttaatgaaacattagccgaggcactaaaaactataataaaaccacactgtatgtattatcatatgcaatgtttaacatgtacatggggggttatagtaatgatgctaattagatatacatgtggcaaaaacagaaaaacaattgcaaaagcattaagctcaatattaaatgtaccacaggagcaaatgttaattcaaccaccaaaaatacgaagtcctgctgtagctttatatttttataaaacagcaatgtcaaatattagtgatgtgtatggagacacaccagaatggatacaaagacaaacacaattgcaacacagtttacaggatagtcaatttgaattatctaaaatggtgcagtgggcatttgataatgaagtaacagatgatagccaaattgcgtttcaatatgcacaattagcagatgtagacagcaatgcacaagcctttttaaaaagcaatatgcaggcaaaatatgtaaaggattgtggaataatgtgtagacattataaaagggcacaacagcaacaaatgaatatgtgccagtggataaagcacatatgtagtaaaacagatgaagggggtgattggaaacccattgtacaatttttaagatatcaaggggtcgatttcatttcatttctaagttactttaaattatttctacaaggaacacctaaacataactgtttggtactttgtggaccgccaaatacaggtaaatcatgctttgctatgagtcttataaagttttttcaagggtctgtcatttcatttgtgaattcacaaagccacttttggttgcagccattagacaatgctaaacttgggttgttggatgatgcaacagaaatatgttggaaatatatagacgattatttaaggaatttggtagatggaaatcctataagtttagatagaaaacataaacaattagtacaaataaaatgtccaccattactaattacaaccaatataaatcctatgctagatgctaaattacgatatttacacagtagaatgttagtgtttcagtttcaaaatccatttccattagataataatggtaatcctgtatatgaattaagtaatgtaaactggaaatgtttctttacaaggacgtggtccagattaaatttggataacgacgaggacaaagaaaacaatggagacgctttcccaacgtttaaatgcgtgccagaacaaaatactagactgttttgaaaaagatagtagatgtattgcagatcatatagaatattggaaagctgtgcgacatgaaaatgtgctatactataaagcaagagaaaatgacattactgtactaaaccaccagatggtgccttgtttacaagtatgtaaagcaaaagcatgtagtgcaatagaagtgcaaatagcactggaatcattaagtacaacaatatataacaatgaagagtggacattaagagacacatgcgaggaactatggcttactgaacctaaaaaatgctttaaaaaagaaggacaacatatagaagtatggtttgatggtagtaaaaacaattgtatgcaatatgtagcctggaaatatatatattacaatggagattgtgggtggcaaaaagtgtgttctggggtagactatagaggtatatattatgtacatgatggccacaaaacatactacacagactttgaacaagaggccaaaaaatttgggtgtaaaaacatatgggaagtacatatggaaaatgagagtatttattgtcctgactctgtgtctagtacctgtagatacaacgtatcccctgttgaaactgttaacgaatacaacacccacaagaccaccaccaccacctccacgtccgtgggcaaccaagacgccgcagtatcccacagaccaggaaaacgacccagactacgggaatcagaatttgactcctccagagagtcccacgcaaagtgtgtcacaacacacacacacatcagcgacacagacaataccgacagtagaagtagaagtatcaacaacaacaaccaccctggtgataagactacgcctgtagtacatttaaaaggtgaacctaacagattaaaatgttgtagatatcgatttcaaaaatataaaacattgtttgtggatgtaacatcaacatatcattggacaagtacagacaataaaaattatagcataattacaattatatataaggatgaaacacaacgaaacagctttttaagtcatgtaaaaattcccagtagtgtacaggttagtttgggacaaatgagttttccataaagtgctgtatatattgtatatacatttgtgttattgtaacacacaaatacgtgaagtgtacctgccatacattgctgctacgcatatatattgcaaccattgatttttgtgttattggtgtgtttgcgctttgcttttgtgtttgtttgcttgtgtgtcatgttgtcccgcttttgctatctgcctctgtgttttccagttgtatattattaataatattgttttggtttgttatagccacatccttttttaatacatttataatatttttgatatttttttactgtcctgtgctgtgtatatatttacatgctttgtggataataaataatatgtaaatgtagtagtactgttactactatggttgcccaccgtgccacacgacgcaaacgcgcatctgcaacacaactatataaaacatgtaagttgtctggtacatgtccagaggatgttgttaataaaatagagcaaaaaacatgggctgataaaatattgcaatggggaagtttatttacatattttggaggccttggcattggtacaggaactgggtctgggggtcgtgcaggctatgttccattggggtctaggccttccacaatagttgatgtaactccggcgcgaccacctattgttgtggaatccgtagggcctacagacccttccattgttacattagttgaggagtccagtgttatagaatctggtgcagggattcctaattttactgggtctgggggatttgaaattacatcctcatcaacaactacacctgccgtgttggatattacaccaacctctagtactgtacatgtcagtagtacccatataaccaatccgttatttattgatccccctgttattgaggccccacaaacaggcgaggtgtctggcaatattttaattagcacacccacatctggtatacatagctatgaagaaatacctatgcaaacatttgctgttcacggttctggtacagaacctattagtagtactcctattccaggctttaggcgtattgcagctcctagattatatagaaaagcatttcagcaggttaaggtaactgaccctgcatttcttgatagacctgcaacattagtatctgctgataatccactttttgaaggtactgacacatctttagctttttctccgtcgggtgtggctcctgaccctgattttatgaatatagtagcattacataggcctgcatttactacacgtaggggtggtgtacgttttagtaggcttggcagaaaggctactatacaaacacgtagaggcacacaaataggtgcccgtgtgcattattattatgatataagtcctattgcacaggctgaggaaattgaaatgcagccattattgtctgcaaataattcatttgatggcctatatgatatttatgcaaatatagatgatgaagcacctggtttgtctagccagtcagttgctacaccttctgcacacttacctataaagccttccacattgtcttttgctagtaacaccactaatgtaactgcccctttaggtaatgtgtgggaaacaccattttattcaggtcctgacatagtgttgcctacaggccccagtacgtggccctttgttcctcagtctccttatgatgttacccatgatgtatatatacagggatcc

SEQ ID NO: 12 - DNA, 11158 bp, Artificial Sequence
  Human papillomavirus type 58 template plasmid (D90400)
tgtgattctgaggtaactatagagccactaggagttggaaaaaatgcactactttggataactgcagtattaccggaccctttaatataaaggtcatccgggacagcctcgccaagttttccagccctattaaaaaagtgtctaacaaacatctgctcacgtctaagaaaaaagaacaaactatccccataaggttcactggccatttttaaataatctggatatttgcatgtactgttacaaatatcaataggcacatcacttttattagcctgcaatgtaccaaagtccatgcatccaaaccctgtatctaccatgtcaccatcctcaataatagaattaaaaagttccaatggaggacaatcagtagcagctgcattattgttacaggcaacacctttaccccaatgctcaccagtgggaggtttacagccaattaaacataattgtgtttgtttataatccatagataagcattccctgttatcagaccctggctgtgcgggatatctgttactggtttcagtgtcatcaaatttatttaaataaggatgaccacttacgccaacacccaatggctgtcccctacctatttcaaggcctacacatgcccagaccaaacgttgtgtatcagggttataaaaagatgtatcaggaaaaccaaatttattgggatcaggtaaacgcaccctaaagaccctatactgtaagcctgataccttgggaactaatacttttttattgttattgggacttttgatggaaaaatatggattgccaacagccaaaagtctggaactgccagcataataataaatgcttgtgcgtgacacatattcatcagtgcttacaaccttagacacaggcacaggaggcaggtacacagtggcctcactaggccgccacacggacatctcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgcaaaaaaatatggaaaacgtttacgtctgcgacgcaaaataaaatagctagggtgcaacataaaatcagcaccatccacaattatggtattaaaaggagttagtggagatataggaataaatggactagacatagatgttacagaagatgcaatgtctggaccaggttccaatgacacaagaggagtgtcaaatccagtatttaatggtatggacacattactggtacgtgtggtggcaaaggacgtatgtgagtgcagaggactctgaaaatcatgtatagtatcagcatcgtcagcataaatatcataaagtccatcattaatactatagggagaaacagaagtatttaaagattgtaattcaaattgttgctgctgttgtacctgttcctggacaggctgtatgggacttaagtcttggtagtaatgtactttagcccctatttgctttccactgcgagtacgaagtgtagccttttgcccaaccctactataacgtacagtacccctgcgagaggttaatgcaggtctgtgtaatgcaacaatatctagaaaatcaggatcaggagcaggcgatatgtcactatgttgaaactgcaatgtgtcctcagggttaaagccttcaaatgctggattatcatatgttacaagtctatgaggagatgttaaaaaagcagggtcaacaaccttaacttgttgggtgttgcgactgtataaaccaaggcgtgccacagggcgagaccctggaatgggtgtgctagacgtgacattgccactgtcagtagaaataacaaaggtatccattggtatgttttcataactatgtgtgctaacagtaggagaggaaaatattaaatgtccagaggcctctgcaggtgcaggagggcggagtacggatggctcagtaaaggagggatttaaatgtgtagaaacagtttgtatagatgattctccaatagaggaaacattaagtattgcaggtgtagtatctgcagaggtggtaatatcaaaaccagatggagtgggaattgatggggctggtgcaccggcgtctataaaactagattcctctattaaagatacaatagaagaatccaaaggccccacagtatcaacggtaactgggggacgtatgggctgtaaaggtatagcctcagacggtggggtactaccaaggggcacatatccagtcctgccacctgtacccgaccctgtaccaatgcctaaacctccaaaaaacacccctaagctaccatatcgtaatatttgatctgctatagtagtgccttcaactttgggtataacatcaggtgggcaggtgcctgaggccttgcatgtttggtaaagttgtgtagcagatgcacgcttgcgccttgtagaccgtttgtgtctcataataagacagtgctaaaaatataaaagtatttattagtaaatgtataaaaataataaaaacaacacacacaacagtaaatatttacaataccataccaccatgtgcagaaccagtatacagttagtcttgttgggttaagtattgtgcatgaaaattaatacacatcattggtatatataaaaatattaagtaacagaaaaaaattcgtagagccgaccccacagacacccaaagcagcaacaccaacaccagcaaccaagcatatatagaaatagatagcaccaatggccgcaaaaaaatgcacaagcataaaaacagtataaaacaaacaacaaaaataggtaatatcattgtatatacacttagcagcacatattggcttgtggtttacatacagtaattgtacaatacaattacaatgacataacaccagtacttatttgcacagtgggtggtattttaacagtgtttaaaaacagttgtcgttgtgtttccgttgtgtatgttacagtaacaattcctactttgtcacctttgtcatcactggtccaatgccatgtggatgacatattacagtataagtctttaaatggttttaatctatatcttaaacattttaaactatttgggtcaccttttaaatgcacgataggtgaaactttagaactacacacgttccgccctttgtatgtacagttagttgtactgtgtagtcctcctcctcgtggtctactgtccacggcgcagtctgtatactttgtggagtactgggtgttgtctctggagtctggtaaatcgagtcgtcgtcgctttgtcccctgtgtactttcgttgttggtggcctcggtggtctttgggtcagcagtttcagtagtggatatttgatcactaggtatagatgtaggacatacaattacccgactacccacatgtacctcccataattgtgttttagagtacttttttgcatcctctttaaaatatttaaaatacgtcttttcattgccatgtatataatacaaccccacatagtcaacttctcctgctaccaaagtacatgttgtttcctcaataatatatatttcactccaatttgtataatccattgtgtttgctttatcattgtcatattgtacagttactgttatgcctttttttttaaagcatttttgtggctctgataaccacacttctaagcttgtttgttgcaatgtccattcatctgttttatatggtgatgcatttaatgtctctaatgccatttgcagttcaattacttgaaacgctttagtctttgatgctaccaatgacggcaccacctggtggcacaaatgtgatattcccatttgtctggctgtatacattatagcacactccatgcgtattagtttccaatgttcaatttgtgatgttaaatcatttttatcagcttcgtatatgtctaggattttgtcctgcactgcacttaaacgtgctgatatttcctccatcgttttccttgtcctcttcctctattaagcctaatttgcaccacgtccttgagaaaaaggatttccaattttcatcatttattttatacactggattaccatttgcatcaaatggaaatggattgttaaattcaaatactgttagtctactgtgcaaatatggccatcgtgaatctttgcctgcatttgtatttgaggtaattattaatggtggacattttaattgtactaatgccctatgttttacatctattgaaatgtcgttaccatctaatgcatttctcatataatcatctatatatgtccagcttatggctgttacatcatctatcatacctagtttagcatctgataatggctgcaaccaaaaatgacttttggaatttacatatgaaataatgcatccttttaaaaaatgtattaaactcattccaaaatatgatttccctgtatttgctgggccacacagtaacatacaacttttttttggtacaccttgtaaaaactgtttaaatgcaactaaaaatgctgtaaattcaatattttgatatcttaaaaattgtactattggtctccaattacctccatcatttgttttttcacacctactttgtatccattgtcccattgtcataccacgcttttctgctcttttataatgtctgcacataacgccacagtcttttactatttttgcttgtgcattgcttcttaaaaatgctgctgcattactattaacatctgctaactgtgcatatttatatgcaatgtcactatcatctgtaatgtcattatcatatgcccattgtatcatttcacttaaatcaaatatatcatcattaaagctatgctgtaacactgttaatctatctatccattctggtgttgtcccttgcacatcacttatatttgacattgctgttctaaaccaatataaggcacatgcttgacttcgtaattttggtggctcgataatcatacatgtttcaggaattgatagtaaattactcattaattttgccacagttaatctatttttgctacatttaaatctaattaacaataataatataattcctctgtcacacgttaaacattgtaggtgtgtatatatactgtgctgtttaattagtacttttaaactttctgctacggagggacttattccataccctgttatacaccaatctgtacagcttgttttatcacttttaaatggtctaactaattccataaaacttactccataagcttctttgaatttatataatagcgttgctttagtattactgttatgtagaatattactaatattttgtaatggaacagtattacaactgtctacatccgtttcactgcttacatctgaactagcccccaccccactagactccgagtcatttaagtctgcgtcgccattttggctttctacctggtgtgccatctgctcagtttccacttcagtattgccatatccgctgtcttctagctcaataatttttcgttttctgtgtgtgcattctttatttttatatttccacgatacacacacatttgcagcccggtccacacagtcctctacagcactttctgagcatgctgcaaactttcgttttagtgcacacacagcatttatatcgtccaccccttcctgtacattaaacaacgctcgggctgcctctgcttctgcctgtgtagtactttgtactgaatcatctataaactctattaaatctgtaccactatcgtctgctgtttcgtcctcatcatctgaaatattatctcctgttcttcgttctattaccgcttctacctcaaaccagccagtacagcccgcccctaccccgtttgtaccttcagggtcatccattgcagatggtgtttattgctgtgcacagctagggcacacaatggtacatgtgcccataagcagctgctgtagggttcgtacgtcggttgttgtactgttgatacacaaacgaaccgtggtgccacaagtgtaacaacaagttacaatgtagtaattagctgtggccggttgtgcttgtccatctggcccgtccaagcctatttcatcctcgtctgagctgtcacataattgctcatagcagaataggtcagttggttcaggatgtaaatctaaaatatattctcttagcgttgggttgtttcctctcatggcgttgttacaggttacacttgtgtttgtctacgtcggggtctccaacacactgcacagcgccctgtccaacgacccgaaatattatgaaaccttttgtttaaatccacatgcctttttttttcttgtggacacaatggtctttgacaaataatacatctaattaatatttcatttaaacacttttttagtgtttgttctaatgtgtctccatatagcgaataattataatgtctatactcacttattttagatagcaatcgtaagcacactttacatactgcaaatggatttccatctctatacactattcttaaatctgcaaatacaaagtcatatacctcagatcgctgcaaagtctttttgcattcaacgcatttcaattcgatttcatgcacagatgtctccaacgcctgacacaaatcatgcaatgtccgtggtttctcctctgcgtcctggaacatagtcctgcagtagcctaccaaaaaatgtctgctttatatatgcaccggtttcggtcagaccgttttcggttacaccctagtttttacaagatttggcattatagtttagtattatataaaatgttgaaacatgaacaatgtgacccaaaacggttagtccacacctggcaataaatgttagtgagtcacttttacaagacatagtttggcataacaaactattgtgcaagccaaaactgcacttaagcattgaaagtaagttaaaatatgtgcctataagcatgtttaaactatgagtataattaaacattttgcaactgcactgcatgtatatatgagtcacatatgcaagtataggcaaaagcagtgcaggaagggaaaggattaactgtattgtttaaattgtagtttaaaaaaaacacgtttgtgccagcaaccgaaatcggttacatgcacaaaatggaggtaaagtaaaatggaggcagtactgttaaaaactataaaatacatatcatacaaatactattacataggtatgcataataggcagggcagggtagggcaatttagggacagcaccttactcatagatacacccaaacaatacaaatagtttacaatacacacaatagtttattacatatatacagaaacaggaaactgacaaggacatagaacatgtacacaaacatgacacataacacatacaacatatacacaaacataaacaaacagacaacacatacataaaacaaacaaacatgtataataaaatagtgtaagtaccacaacaattattttttaacctttttgcgtttggtggatggtgcacgggtagtaggggccgaacgttttagtctgggctttgctttaaggcctgattgtaataaaaactttcgtcccaaaggaaactgatctagatcccctcgactctagaggatctgcagaaaacttttcctttaagttaacctcccaaaaagtatatttatttaatggatcttccttttctttagggggtgctgttttttggcaagtaatagcctgggaggtaacaaatctatatgtgtcctgtaaactggcagacggaggaggtgttaaaccaaattgccagtcctccaaaatattggaatccatagtatgtatatatgtcattatctctgcagttagtgtaattttgcaaagctgaaaaacaaactgtaagtcatattcttcaacatgacgtacatattccttaaaattatcatttttatatgtaccttccttagttacttcagtgcataatgtcatattagtgctacgagtggtatcaaccacggtaacaaataactgattgccccagcaaatgccattgttatgaccttgtgcacgctgtagccaataaggcttattaaataattgtgattctgaggtaactatagagccactaggagttggaaaaaatgcactactttggataactgcagtattaccggaccctttaatataaaggtcatccgggacagcctcgccaagttttccagccctattaaaaaagtgtctaacaaacatctgctcacgtctaagaaaaaagaacaaactatccccataaggttcactggccatttttaaataatctggatatttgcatgtactgttacaaatatcaataggcacatcacttttattagcctgcaatgtaccaaagtccatgcatccaaaccctgtatctaccatgtcaccatcctcaataatagaattaaaaagttccaatggaggacaatcagtagcagctgcattattgttacaggcaacacctttaccccaatgctcacca

SEQ ID NO: 13 - DNA, 7896 bp, Artificial Sequence
  Human papillomavirus type 59 template plasmid (X77858)
gttaagaccgaaaacggtgcatataaaggtagttgaaaagaaaagggcaacggcatggcacgctttgaggatcctacacaacgaccatacaaactgcctgatttgagcacaacattgaatattcctctgcatgatattcgcatcaattgtgtgttttgcaaaggggaactgcaagaaagagaggtatttgaatttgcttttaatgacttatttatagtgtatagagactgtacaccgtatgcagcgtgtctgaaatgcatttcattttatgcaagagtaagagaattaagatattatagagattccgtgtatggagaaacattagaggctgaaaccaagacaccgttacatgagctgctgatacgctgttatagatgcctaaaacctctatgtccaacagataaattaaagcatataactgaaaaaagaagattccataatatagctggaatatatacaggacagtgtcgtgggtgtcggacccgagcaagacacctaagacagcaacgacaagcgcgtagtgaaacactggtgtaaaacaatgcatggaccaaaagcaacactttgtgacattgttttagatttggaaccacaaaattatgaggaagttgaccttgtgtgctacgagcaattacctgactccgactccgagaatgaaaaagatgaaccagatggagttaatcatcctttgctactagctagacgagctgaaccacagcgtcacaacattgtgtgtgtgtgttgtaagtgtaataatcaacttcagctagtagtagaaacctcgcaagacggattgcgagccttacagcagctgtttatggacacactatcctttgtgtgtcctttgtgtgcagcaaaccagtaacctgcaatggccgattcggaaggtacagatggggaagggacggggtgcaatggatggttttttgtgcaggcaatagtagataaaaaaacaggtgacaaaatttcagatgacgaggatgaaaatgcaacagatacaggttcagacttggtagattttattgatgataccacaacaatttgtgtacaggcagagcgcgagacagcacaggccttgtttaatgtgcaggaagcccaaagggatgcacgggaaatgcatgttttaaaacgaaagtttgggtgcagtatagaaaacagtagtgagaaagcggcggcaggaaaaaaagctaagtcaccattacaagaaatatcagtaaatgttaaccacccaaaagtaaaaagaaggttaataacagtgccagacagcggctatggctattctgaagtggaaatgctcgagactcaggtaaccgtggagaatactggaaatggggatagcaatggcagtgtttgtagcgacagtcaaatagactgtagcgacagcagtaacatggatgttgaaaacatagttccaacatcccccactaatcaattgttacagttattacatagcaaaaataagaaagcagctatgtatgcaaaatttaaagaattgtatgggttatcatttcaagatttggttaggacatttaaaagtgacagaactacctgtagcgattgggtaaccgccatttttggtgttaatccaactgtagcagaaggatttaaaacattaatacaaccctatgtgctatatgcacatatacaatgcttagattgtgcatggggagtagtaatattagcattattaagatataaatgtggaaaaaatagaataacagttgcaaaaggacttagcacattactacatgtaccagatacgtgcatgttaattgaaccacccaaattgcgtagtggtgttgcagcactatattggtacagaacaggaatgtccaatattagtgaagttataggggaaacgcccgaatggatacaaagactaacaattatacaacatggagttgatgatagcgtgtttgacctgtcagaaatgatacaatgggcgtttgataatgacctaacagatgaaagtgatattgcatatgaatatgcattaatagcagatagtaatagtaacgccgctgcatttttaaaaagcaactgccaggcaaaatacctaaaagattgtgcagttatgtgtaggcattataaaagagcacaaaaaagacaaatgagtatgtcacagtggataaaatggagatgtgataaaatagaagaggggggagattggaaacccatagtacaatttttaagatatcaaggagtagaatttataacgtttttatgtgcattaaaagattttttaaaaggtaccccaaaaagaaattgcattgtgctgtgtgggccagcaaatacaggcaagtcatactttggaatgagcctgctacattttttacaaggaactgtaatttcacatgtaaattcaaatagtcacttttggctagaacctttaacagatcgtaaattagctatgctagacgatgcaacagatagttgttggacatattttgatacatatatgcgaaatgctttggatggcaatcctataagtgtagatagaaagcataggcacctagtacaaattaaatgtccaccaatgcttattacatcaaatacaaatccagttacagataacaggtggccatatttaaatagcagattaatggtatttaaatttccaaacaaattgccatttgacaaaaatagaaatccagtatatacaattaatgacagaaactggaaatgtttttttgaaaggacgtggtgcagattagatttgaacgaggaagaggaagatgcagacagtgatggacaccctttcgcagcgtttaagtgtgttacaggatcaaatattagaacattatgaaaacgatagtaaagacattaatgaacacataaactattggaaactggtgcgtatggaaaatgtaattttatttgcagcaagagagaacaatatacatacattaaaccaccaggtggtgccaacgtttttggtgtctaaaaacaaggcatgtgaagctattgaactgcagtcaaaccgtacttccactgtaatgccctgttttttaaaacattttttaggtgctgtttgccatagttcttggcatgtttcttgcattgtccattgctcatttttaaactcagtttgtgccaaactctctaacgccatctgcagcaaggaaaacacaatgcattacacaagctggacatttatatattatgtaaatgatgtaggacagtggtgtaaaaccacaggaaatgtggacttttggggactatattataaagtggaagaggaacaggtgtactatgtaaaatttatacatgatgccaaaaaatatgggactacagacaagtgggaagtgcattataatggcaaggttattgattgttatgactctatgtgcagtaccagtgacgagcaagtatccactgctggatcttctgagcaactatcatacccctccgcaacgccccccgaagccacgtacttgggcccccaaacgtggaaccgtcagacgaagactggaaagcgaccaagacagtgtggatacacacagcaccctcagtctaccagcgtgtcagtggactactgtgacaacccagtcgtccgtttgcatccaggcaacaacccgcgacggcacatcccttgcagtaacactacgcctataatacacttaaaaggtgacaaaaatggccttaagtgtttaaggtatagattaagaaaagtacactggttatttgaaaatatttcctctacctggcattggacaggaaacagaggatcagccaaaacaggcattttaacattaacatatacaagcgaaacacaacgcaatgaatttttagatactgtaaaaattcctaatagtgtacaaatacatgttgggtatatgagtgtgtaatggttgttatgcaaatgtaacacaagccaatactgctgctatattgtatagctgaggaaatgataacccttgtatttgtgtgttgtgtttgtgtttgcttgtgtgtgtgttgcaatgtcccgcttctgcaatctgtctatatgtgtgcatatacatggttactagtatttgtgtatattgtggttatcacctcctcatatgagtgttttttactatatatattgttttttataattccactgttactactatatgcccatgcaatactgtccatacaataattgctgtatattgtaaattacattgcactgtattgtacagtatattttaaacacattattatttttgttaggtgttggttttgttacatttataataaaacatggtttcccatcgtgctgctcgtcgtaaacgtgcctcagcaacagacttatataaaacttgcaagcaggcaggtacatgcccttctgatgttattaataaagttgaaggtacaactttagctgataaaatattgcagtggaccagcctaggaatatttttaggtggactaggtattggtactggatctggtaccggtggcagaacagggtacatacctttaggggggcgtacaaacactatagtagatgtatcgcctgctaaaccaccagtagttattgaacctgttggacctacagatccatctatagttacattagttgaggattctagtgttataacatctggagcccctgccccaacatttacaggtacttcaggatttgaaatatctacctctagtacaacaacaccagctgttttggatataaccccaacctcttctgttcaaattagtagctctagttttataaatcctgcatttacagacccttctgtcattgaggttccccaaacaggtgaaatttctggtaatatattaattagtacccctacctctggtgcacatggctatgaagaaattccaatgcaaacgtttgctacggaaggtactggtttggaacccattagcagtacccccaatccaacagtacgtcgtgtggctggacctagattgtacagtagggctaatcaacaagttcgggtgtctaacgctgactttttaacacgtccatccacatttgttacatatgataaccctgcttatgatccaattgatactacattaacttttgacccctcatcagaggttccagacccggactttatggatatagttcgtttgcataggcctgcattaacatccagacgcagcactgtaaggtttagtaggctaggacaacgggcaaccatgtttacccgtagtggtaaacaaattggggcccgtgtacatttttatcatgatataagccctataccacatgctgaagatattgaattgcaacctcttgtttcttcccaggctgctactgatgatatatatgatatatatgcagatattacagatgaagcacctactagtactgccaacactgcatttacaattcctaaatcttcttttcaaagtttgtcattaacacggtcggcatctagcaccttttcaaatgtaactgttcctttggctactgcctgggatgttcctgtaaatacaggacccgatatagttttacctaatactaatattgttgaacccacttattctactacaccctttaccaccatacagtctattaatatagaaggcacaaattattttttatggcctatatattattttttacctcgtaaacgtaaacgtgttccctatttttttacagatggctctatggcgttctagtgacaacaaggtgtatctacctccaccttcggtagctaaggttgtcagcactgatgagtatgtcacccgtaccagtattttctaccacgcaggcagttccagacttcttacagttggacatccatattttaaagtacctaaaggtggtaatggtagacaggatgttcctaaggtgtctgcatatcaatacagagtatttagggttaagttacctgatcccaataaatttggccttccagataacacagtatatgatcctaactctcaacgcttggtctgggcctgtgtaggtgttgaaatcggtcggggccaacctttaggggtaggactcagtggtcatccattatataataaattggatgacactgaaaactctcatgtagcatctgctgttgataccaaagatacacgtgataatgtatctgtggattataaacaaactcagctgtgtattattggctgtgtacctgccattggagaacactggacaaagggcactgcttgtaagcctactactgtggttcagggcgattgtcctccactagaattaataaatacaccaattgaagatggtgatatggtagacacaggatatggggctatggactttaaattgttgcaggataacaaaagtgaagtaccattggatatttgtcagtctatttgtaaatatcctgattatttacaaatgtcagcagatgcttatggagacagtatgtttttttgtttaaggcgagaacaggtttttgccagacatttttggaatagatctggtactatgggtgatcaacttcctgaatcactatatattaaaggtactgacatacgtgccaacccaggcagttatttatattccccttccccaagtgggtctgtggttacttctgattcacaattatttaataaaccatattggctgcacaaggctcagggtttaaacaatggtatatgttggcacaatcaattgtttttaacagttgtagatactactcgcagcaccaatctttctgtgtgtgcttctactacttcttctattcctaatgtatacacacctaccagttttaaagaatatgccagacatgtggaggaatttgatttgcagtttatatttcaactgtgtaaaataacattaactacagaggtaatgtcatacattcataatatgaataccactattttggaggattggaattttggtgttacaccacctcctactgctagtttagttgacacataccgttttgttcaatctgctgctgtaacttgtcaaaaggacaccgcaccgccagttaaacaggacccttatgacaaactaaagttttggcctgtagatcttaaggaaaggttttctgcagatcttgatcagtttcctttgggacgtaaatttttattgcaattaggagctagacctaagcccactataggcccacgcaaacgtgcagcgcctgcccctacctctaccccatcaccaaaacgtgttaagcgtcgcaagtcttccagaaaatagtgttgtttgttatgtgtttgtatgtgtgcatgttgtatgttttgtattgtttgcctgtttgtatgttgtgtatatgtacatgtttgtttgtctgctgtatgtgtgtatttgtttttgtacataataaagtatgcatgacagtttcatgtgtggttgcacccaatgagtaaggtactgtccctttattgtttctttgtccttattacacattattacacattgccctacttacataggtgtgtttgttccttcattttgtcctgaatgtccagttttgcatttgcacattatatggcgtccattttatcctttaaatcctccattttgctgtgcaaccgttttcggttaccttggtttaaccttacctttttgaacaattaatctgtttaaacatcagcaaaacagttaatccccatcttgtttcctcctacacgcctagactactaacacaacttacaaacgccaaatagttagtcatcatcctgtccaggtgcactctaacaatacttgcataactttggtggcgcccttgttaataaaacagcttttaggcacatattttcactgtttttactactttaattgcataattggcttgcaaaactactgtgcaatccaagaatgtgtctataatttattgtaaaaaacatgactaaggtttttgtcattgttaagcaaccgaaaaaggtcgggcaagtacatgcacactttctacttattactttttacaatcatagtaataaaaaagggtgtaaccgaaaacg

SEQ ID NO: 14 - DNA, 10735 bp, Artificial Sequence
  Human papillomavirus type 66 template plasmid (U31794)
tcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgtaaaaaaatagggaacacgtttacggcgcctacgtttaaaaaaatatacaggccatagtgcaaatgtacctccctgtatatatacatcatgtgtaacatcataaggagactgaggtacaaagggccaagtactggggcctgtaggtaaaactatatcaggaccagaataaaatggtgtttcccaaacatttcccaaaggggcagtaacattagttgtgttactagcaaaggataatgtagaaggtttaataggtaattgtgcagaaggtgtagcaccagactgacgaaatgaaatgggtgcctcatcatcaatatttgcataaatatcatataggccatcaaatggattgtctgtagacaataatggctgcatttcaatttcatcagcctgtgcaataggacttatatcataataataatgcacacgagcacctatttgtgtacccctacgtgtttgcatggtagcctttttgcctagcctactaaaacgcacacctgttctacgtgtagtaaatgcaggcctatgcaatgcaactatatccataaaatcaggatcaggagccacacccgagggagaaaaggtcaacgttgtgtcagcaccttcaaaaacaggattatcagcagttattaatgttgtggggttgtccaaaaatgctgggtcagtgaccctaacctgctgaaaagccctactatacaatctgggagcagcaaggcgtctaaaacctggaataggggtactactaataggttcgttgccagtaccgtgtatagcaaatgtttgcataggtatttcctcatagctacgtattccagatgtaggagtgctaatcaaaatattaccagatacctctccagtttgtggagcctcaattactggaggatcaatatatagtgggtttgttatagtagtactacttacatgtacagtactagatgtgggtgtaatatccaacacagcaggtgtggttgtagaagaggatgtgacctcaaagccccctgacccagtaaaattgggaacaccagcccctgagttaataacactagattcttctaccagtgtaacaatagaaggatccgtaggcccaactgactccaccacaataggtggtcgtgcaggagtgacatcaactatagtagaaggcctagagcctaagggaacatagcccgcccgaccacccgacccagacccagtaccaatgccaagtcccccaaaatatgtaaataaacttccccattgtaaaattctatcagcccatgttttttgctctaccttattaataacatcctcaggacatgtaccaggtaatttgcatgttttatataattgtgtggcagatgcgcgtttgcgtcgtgtggcacggtgggcaaccatagtagcaaaaacgtaatactgttacaaatggtttattaaccacaaagcatgaaaatatatacacagtgtaggtatataaaaaaatagtaaaaacagtataaatgtatcaaaaaatgatgtagccacaacaaaccaaaataaagtaattagtataagacaattggtaaacaaagatgcagatagcaaaagcgggacaaaatggcacacacacagacaaacacaaaagcaaagcgcaaacacacaaattacacaaatatcaatggttgcaatatatagcgattacacgttaccgtttccagtgttacaataacacatactataccaaatacaattaatgggtgcaatatatatgcgtagcagcaatgtatggcaattacacttcatatgtatccgtgttacaataacacatatgtatatacaatatatacaacactttatggacaactcatttgtcccaaaataacctgtacactaggtggtatttttacaacatttaaaaaggtgtcccgttgcgtttcatctttatataatattgtaataatactactgtctttattatctgtacttgtccaatgatatgttgttgttacatctgtaaataatgttttatatttttgaaatctgtatctacaacactttaatctattggcttcaccttttaaatgaattgcaggtgtagtcttatcaccacagtggttgtgtgtgttgatacgtgcacttctactgttggcgttgttactgatgtctgtgtctgttgtgacacggtgtgcgtaggactctctggaggagtcaggttctgattcacttgctctgggtcgttttcctggtctgtgggataccgcggcgtcttgggcgcccacagaggtggaggcggtggtggtggtcctgtggttgttgtattcgttaacagtctcaacagggggtacgttgtatctacaggtactagacacagagtcaggacaataaatactctcggtttccatatgtacttcccatatgtttgtacacccatattttttggcctcctgttcaaagtctgtgtaatatgttttgtggccatcatgcatataatatatgcctctgtaatccacccctgatgacactttacaccacccacactctccattataatatataaatttccacaccacatattccatacaattatttttgttaccatcaaaccacacttctatatgttgtccttcttttttaaaacagtttttgggctccgtgcgccacagttcatcacatgtatcacgtaatgtccactcttcatttttatatattgtgttacttattgcttccagtgccatttgtaattctattgcactacatgcttttgctttacacacttgtaaagagggcaccatctggtggtttagtacattaatgtcattttctcttgctttataatataatacatattcatgtcgtacagctttccaatagtttatatgatctataatgcatttactatctttttcataacagtctagtattttgttctggcacgcatctaaacgttgggatagagtctccattgttttctttgtcctcgtcgttatccaaatttaatctggaccatgtcctttcaaaaaaacatttccaatttacattactcaattcatacacaggattaccattgttatctaatggaaatggattttcaaacttaaacactgaaattctactgtgtagatatcctaattttgcatcttgcataggatttacattagttgtaataatgactggaggacattttatttgtactaattgtttatgtttcctatctaaacttatgggattcccatctaataaatttcttagataatcatctatatatctccaacacgtatctgttgcatcatccagcaaacctaatttggcattgtctagtggctgtaaccaaaagtggctttgtgaattaacaaatgaaatgactgacccttggaaaaaatttataaggctcatagcaaaacatgatttacctgtatttggtggtccacacagtaccaaacaattatgtttaggcgtgccttgtaaaaataatttaaaataacttaaaaatgaaatgaagtcgaccccttgatatcgtaaaaattgcacaatgggtttccaatcaccaagccaagcttaattcggcttcccttcatctactttactacatatatgctttatccactggcacatattcatttgctgttgctgtgcccttttataatgtctacacattattccacaatcctttacatattttgcttgcatattactttttaaaaatgcttgtgcattactatctatgtctgctagttgtgcatataaaaaggcaatttggctatcatctgttacgtcattatcaaatgcccactgtaccattttagacaattcaaattgattgtcttgtaaactgtgttgcaattgtgtctgtctttgtatccattctggtgtttccccatacacctcactaatatttgacattgctgttttataaaaatataatgccacagcaggacttcgtagttttggtggttgaattaacatttgctcttgtggtacatttaaaattgagcttagcgattttgtaattgtttttctgttttttccacatatatatctaattagcatcattacaattaccccccatgaacatgttaggcattgcatatgatagtacacacattgtggttttagtatagtttttaacgcttctgctaatgtttcattaacaccaaatattgcacatatccaatcgttacaacatgtactatcgcttttaaatgttcgcaccaactctgtatatggcactccatacacttctttaaatttaaaatgtaatcttccttgtacgttactacttttaaatagttcctgcaattggtgtgttggtgtttccatatttgtatctatatccatatttaccaccgagtgctcactacagttactgttttgcgagcctccattttgtgagctcccgcacccatttcccttttcgtattctacctgttgtgatgtttccaatgtttccaatgtattgccgtacccgctgtcttctgataatattagccttcgttttacttcctcccggtacacagtttgctgattactaatatcacttaagggactacctatatactttcgttttagtttttgcaacgtctgtgcatctgcatgtgctgtttgtacttgcaataattgttgagctgtctccctgtcttcctgtgtattgtttataagtgtattgtctataaatccatctaaatctgtatctgtttcattctcctcctcgctttcatcatctgatattgtatcccccgtttttctttctacaattgcttctacctgaaaccatccacaacatcccgtcccctccccatttgtaccttcaggtgatgccattgcagttatttagttgacgcgcagagtgggcacgttactgttaacgcacccataagcagctgttgtaccacacgtagctcctctttggtactctgaatgtccaactgcaccacaagctcacacttacaacaaggtacgtgaattaggtaacacttatgttgttcagcttgtctagcttgctgtggccgctccagcaaatggtctatttcatcctcatcctcatcctctgagctgtccaattgctcattgcattgtaggtcaatttcagtttgcggtgcaagttctaatataatctcttgcaacgttggtgctttaccatgcatggttatactgtagattctgtggcttgtctactcgtatgtctccaacactgcaaacatgacccggtccatgcatatgctatataatgaaatcgtcttttatgttcacagtgcaattgtttttcctccggtgttaacggacattgacatcggtagcaccttattgataaatcagataactgttttttagttataccttctaatgttgccccatacactgaatatttatagtacctatattttctaaccttactataaaacaataaacataccctacatactgcatatggccaattgtttctatatactaattttaactcaatacatgcaaacctatataactctaaacttgtaagttcctttttgcagtatacacatgataatctaagatcaagtaaaggtatttgtaatacctcgctcagatggtgcaggcttcgtggacgttcctgtgtattgctgaatatggaatccatggatatctacaggcacaacaggctgccttttatatgtaccgttttcggtcctaaacccatttcggttactcccaatataataaagtatgattgaaactttcaacaattaaaagaaacctgtcttagcacgaccgtaaacggttttgaaaaatgagtaagtatatggttacatatttgcaagacagatacttggcttatacaataagggctacacgccaacaaaatatattgcaaacacctgcataaaaacatatgcccaacagcgccaaagtatgcagataaaagcatagttggcacagaaatactggtgagtaatacagggtaaggcagtgtacatacctgaatcatacaacaggaaacggcaatatgccaaaggattaactgttttgctgaaaagtcgttttgggtttaaataaggacaaaaggctaggcaaccgaattcggttgcatgcataaaatggcgtacagcactaaaatggagtttggtatgttactatagtgcatacaaacaacctatttaatataacagtaaacagtaaggaacaccacctaacctgacacacactgcccaaggatactaccgcaccttagtttatgcaaccacgcgtaaaagtaaccatgcatgtttattacatacacacaaaacattacacatacatacagtcatacatacacatagcacatacacaattataaaatacataaacatacacaaaaacatacagtacaagcacaaccatacaatacatacaacagacaacacacaactatcgtcttttacgtttagctggtaaagaagaggaagaggtaggagccgcccgctttttagaggcagatgcactagccttgggtctagggcctagttgcattaaaaattttctacccaaaggaaactgatctaggtctgcagaaaagctgtcctgtaaattaacctcccaaaacttatatttagccaggggatcctgcttttctgcagggggctgttccctttgacatgtaatagctgtgcttttaatatgcctatatttatcctctaagctagttgcaactggtggggacaatccaatgttccaatcgtctaataaagtattattcatattatgcaaatatgccataacttctgcagttaaggttattttacaaagttgaaacacaaactgtagttcatattcctccacatggcgaaggtattgattgatttcacgtgcatcatatttagttaatgtgcttttagctgcattaatagtcatgttggtacttctggtagtatccacaacagtaacaaatacctgattaccccagcatatgccattattatggccctgtgcacgttgcaaccaataaggtttattaaataattgggcctcagaggtaatcatggacccactaggagtagcaacatatacagaactgggaggagggtccctgccattgccacccttccaatacaaatctgtaggaatggcttccccaacattacctgccctattaaagtaatgtttggcaaacaattgttccctgcgtaagtaaaaccacatagaatccccataggcatctgcagacatttttagataatcaggatatttacatgtagattgtacaatgtccaatggcacctcagcctttgattcctgtaattgcttaaagtccattgcaccaaacccggtgtccaccatgtcaccgtcctctattggggtattaactaatgccaaaggtggacaatcccctgtattgactggtgtagacttacacaccgcgcccttagtccaatgttcacctaatgctggcgcacatcccacaatacataactgggtttgtttacaatcaacagatatattgtcccggttatcttctgcaacattattacttgctaaattagagacttcagtgtcatccagcctattaaataatggatgaccacttaacccagcacctaaaggttgacctcggcctacctccaaacctacacaggcccataccaaacgttcctggtcaggattatagaaagatggatcaggaaggccaaacttattaggatcaggcaaccgtaccctaaacactctatactgatatgcactaactttagggatgtttgttttggtaccagatttagaaacagagtaataaggatggccaacagcaagcaacctagagctacctgcatgataaaatatactggtacgttttacatatgtatccgttgccacaacctttgaaacaggtgttggaggtaggtacaccttattgtcactagaacgccatagagccatc

SEQ ID NO: 15 - DNA, 7828 bp, Artificial Sequence
  Human papillomavirus type 68 template plasmid (DQ080079)
ctgtaaaaaaataaggaaggtgtttacgtttttttaataaaaagaataacaatggtaataaataataattggaaccatatatagttatggcaaaggttgtatcaattggagtagagggtgttaaaggcaactgtggggttgtagatggtaatacaacatcaggaccagtatttacaggcgtgttccaagcagtaccaagaggaatggtagtattagtatatgtagtggatgcagcagaagccaatgaaggaactgatatgtgggaacgagtagtaaatgtagcattatgaaatgcagtatctaatactgtagtattgtcagtatcaggtgcatatatatcatataagttatccatagggtccgcctgctcaggggcaaccaatggttgtagttcaatgctgtcagcaggggtaatgttactaatatcatgataatagtgcacctgtgccccaatttgtgtacctcggcgtgtaaacatggtcgcctttttgcctactctgctaaaacgtactgttcctcttcgggatgttaaggcaggcctatgtaaacgaacaatgtccagaaaatccggatcaggagctatgtcagcaggttcatatgtaagagtagtatcaacaggctcaaaagcaggattatcaaatgttacaaatgatgaagggtgcgttacaaaatcaaaattactaacacgaacctgttgatgtgccctactatataaacgtggccctgccacacgactaaccccaggtataggagtactactaataggttctgtaccagtgccatgtgttgcaaatacctgcataggtatttcctcatatccatgtgttcctgatgtaggggtacttacaaacacattaccagacacctcacctgtttgtggcacttctattatagtcgggtctgtaaatgcagggttagtaaaactagtactgcttacctgcacagacccggacgaaggggtaatgtctaaaactgccggtgtagtggtagacgaagatgtaatttcaaacccagaggtgcctgtaaatgttggtactggtgtcccagatgtaataacactggaatcctccaccaattgcacaatggagggttccgtaggacccacaggttcaataaccacaggtggacgtgcaggcgacacatccacaacagtattaggttttccacctaaaggaatgtacccagcacgacctccggtgccagagccagtacctatacccaggccacccaaaaatatacctaaacttgtccattgtaatattttgtctgcaagtgtagtaccttcaaccttatttataacatcagaaggacatgtccctgattgtttacatgttttatataagtcagttgcagatgcacgcttgcgcctggcagcacggtgtgaaaccatatttatttatacaaataaacaacaatacaaatgcacactataacagttactgtatagtattaagagtaagactgtgtaataaccacataggcagtataaaaaaaagtaggtatacagcaaacacctcaaatggtgtagttctaactaatataaacacaaacacaaatatccacacatacacacacacatgcacagactgcaaaagcgggacagtgcaacatatatacatgcatacacaaaaccacaccaaaaataccaatacaagcatatgtatacaatatacatatagtgtacagtgtgggtcaatacacacttataatgtcatataccccaatgacacagttacactagatggtagtttaacagtttccaaaaacttgtcacgttgtgcttctgaaacatatgttacagtcaatatacctgtattggttgatcccctaccccttatccaatgccatgtacatgatatattgtcatacaaagcgttatgtttttgcaacctatacctaagacattttaatccatttttgtcaccttttaaatgcactataggtgtagtgtcaccacaacaaaggctccgtcttttgttttggcctgcacttctactgaggagtgggaggtcgacaccgtccacggacacgttgtcgggctcagagggctcagtgattccgcactgtctgggatacttccgagacgacgtcgagtttgtttttttggtgcatggggcacctgcggtggtatgggtcgcggtggtgttctgtaggtcggcaacagattcagtagtggatacttttccgtcagtggtactgcacatagagtcaggacaatggattatgttgccattataatgcacgtcccattttccactagtcccatatagttgtgcatcctgcataaacctttcgtaataggttttttgttgttcatacatataatatacaccccagtaatccacacgcccttgggttttacaccatgtgtctgtactgtttttaaagtaaattgtaccccacactacataatgcattgagttactcttgtccccatcataccatacttccactgtaacaccatgttttttaaaacattgctttggctttgtatgccatagttcattacttgtgtcccttaatgtccactcctctgcactatatgcagttttagcaaggctctctagtgccatctgcagttcaatagcttgatatgctttagtttttgaaatgtttacaggcggcaccacctggtggtcaatattatgcataccacgttctcgtgctgcataatatattgcattttccagtcgcacacaattccaatagttaatatggtcctgtatacatttactgtcctgttcataatgttctaatattttctcctgtaacacatttaaacgttgggaaagtgtttccatcattgtctccttcatcctcgtcctgctgcaagtctaatctgcaccaagtcttttcaaaaaaacatttccagtttttatcattgattgtatacactgggttcctgttttggtcaaatggaaatgcattaggaaatttaaacacggttagtctactatgtaaatacggccacctattgtcttctacagggttagtattggatgttattagcattggtggacactttatttgtattaggtgtctgtgttttctatctaaacttattgggttaccatctaatgcatttctcatgtaattatcaaaatatgaccagcatgtacctgttgcgtcatctagcatggctatttttgcatctgcaagtggctctaaccaaaagtgacttgctgaatttacatatgaaattattgtgccttgtaaaaaatgtataaggctcatgcaaaaatatgacttgcctgtatttggcggcccatgtataactatacaatttcgttttggcgtgccttttaaaaaatcttttaatgcacataaaaatgttataaattccagtccttgatatcttaaaaattgtacaattgggcgccaatcaccgccttcgtcacatttactgcatctaaatttaatccattgtggcattgtcatttgtcgtttttgcgcccgtttgtaatgtctacacattgttgcacaatcttttacatattttgcttgacagttgctttttaaaaacgctgcagcattactattacaatctgctaacatagcatattgaaatgctatatcactgtcatctgttaactcattatcaaatgcccattgtaccatgtctgataaatcaaatacactatcatctattccatgttgtattatggttaatctttttatccattccggcgtgtcgccacacacctcactaatattagatattcctgttctataccaatataatgctgcaacagggctacgtaattttggtggctgcaaaagcatacagctgtctggaacatgcaacaatgtactcaatccttttcctactgttattctattttttccacatttgtatcttattagcattagtattaatattccagtttttgtatctaaacattgtatatgggtatacaatgcatattgtttaattagtgttttaaacccttccgcaatggttggatttactccaaatattgctgctacccagtctgtacatgtggttttatcacttttaaatgtacgtaccaggtcattaaatgacaatccatatacttttttaaattctgttaacattgcagcctttttattgttacattgtaataatactttaagttgggtagtaggtgatttaggatcctggttttcactatctatagcactgtccacactactacagtcctcccgtatactgtcgccattttccccttcattttccccatcctccccatttatattaggtgctacagttacctccgagttagtttccacttccatattgccatagccgctgtccggcactgtatacgccggttgtcttgcctgtgtactgcttacatttagtgataattcctgtaatggcgactttgctaaaggactgctttctatactgtctgtatactttcgttttagggcacgcaccctttgtgcatccctttgggcctcttgcatattcaaaagtacctgtgctgtctcacgctctgcctgtatacaaatatgtgtagaatcatcaataaaatctaccatgtctgaacctgtatctgttgcgttttcgtcctcatcctctgagactgtgtcacctgtttgtttatctactattgcttctacaaaaaaccatccgttacaccccgtcccgtccccatcggtaccttcacaattggccattgcagattactgggtttcagttgcacaccacggacacacaaaatttagtgagtccataaacagctgttgtagtgtccgcaggttgtcccgcgacgcttctactactagttgcagtgccttgttacacttacaacacagacactgaattcgaattctgtgacgctgttgttcgtcccgtctggctagtagtagatgttggtggtgattaactgcatggtcgggttcatctatttcatcgtctgaatctcctaattgctcgtgacatacaaggtcaaccggctgtatttcattgtatggacatagctctaacacaatttcctgcacggtgggctttggtccatgcatagttacttaaacttgtgtttcttgacgtatgcgtctgcggtcctctcgcttactggtccagcagtgccgacactgtcctgtaaagtttcctgctattttatgtaatcttcgttttgttgttaggtgccttagtttttctgctggacacaatggtttcaggcaactcatgcaccttatcaataaattatataactttgtattagttatggtttctaatgtagttgcatacaccgattccgagtaatatcgtagttcccgtattttagcataaaatttaatacatgattggcatgcagcaaatggtaccccgtctctatacactacacataggtcactaaaggcaaattcatatacctctgtccgttgtagttgccttctgcaatagacacagtctattgtaacgtcatgcaatgtagtgtccaatgtcctgcacaggtctggcaatttgtatggccgttcctcagggttgtgaaatagcgccattagtatagagaactgctgtgttcagctttatatacaccgttttcggtcgtgaccgttttcggtcccaccctttttttatatagaataattgtaaaatgttataagtaaaagtattggtatgtgtgcccaacctttttcggttgcacaaatttatggatgtagtattagtcactgtataacttacactaccagacagattcttgaatgcaaaagtagttatactggccaactatgctattaggcaagcaaaaacagttaaaactttatgcctaaaagcagttttattacaagggaggagatacgttggttgccaaactattgttgcagtgcacctggacaggatgatgactaactaaggtgcgccagtacgactgttactggtgccaactatgtgggtaactcaaggtaaaacatgtttttgctgaaacacataggttttaatactatctaaaagcaaatagtaccaacgaccgaaagcggtcgcacacaacccggccatacaaaatggccacacggtatagtttgcaaccataaatatattgcatataatgtaacacaccttagggtagggctacaaattatgtatgaaatgttgcagtcctattatatgtaaaacaaggacatatgttagtcacagggtgcaaccacaaaggacacggacatacatactttattaacaaaaacagattatacacacatacttgcaaacatacacatatacacatacacatacatgcacatacacaacataccaacaccaacatgacacatatacaaccacacagacaaacaacatacaaaacaagacatataacaattattttgacacacgtttacgtttgtgtttagaggtagatgtggtagctgcagtggcagtgcgtttacgagggcctatggtgggccgtctgcgaacacctgcctgtaacagaaatttgcgtcctaatgggaattggtccagttcagaactaaacttttcctttaaatccacattccaaaagttaagaccatcatagggatcttttttaacaggtgcaggggcgtccttttgacatgtaattgctgctgattgtaggtagcggtatgtatctacaagactagcagatggtggaggggcaacaccaaaattccaatcatccaaaatagcaggattcatagtatgtatatatgacattacatcagtggataatgttatagtacacaactgaaatataaactgcaaatcatattcctcaacatgcctaacatattccttaaatttattagaatcatacacagctggtacagtagagtctgtagtagtggacaatgtaaaattagtactgcgcgttgtatccacaacggtaagaaataattgattatgccaacaaataccattgttgtgtccctgtgccttgtgcagccaatagggcttgttaaataactgggagtcagaggacaccatagacccgctaggcgagggggcatacacataactactaggagtttcacgaatgtcagtgcccttaatatacatgtcagtgggaatagtgtcccctaccatgcctcccctattccaaaaatgcctggcaaataactgttccctacgtaaacaaaaaaacatactgtctccatacacatctgcagacatttgcaaatagtcaggatatttgcaaacagattgacatatatccaaaggtacctcgcttttcgtttcttgtaatgtaccaaagtccatagcaccatatcctgtatcaatcatatcgccatcctcaataggagtatttaccaattccaatgggggacagtccccttgttgtacattggtaggcttacaagatttacctttggcccagtgctcgccaatagcaggaacacagcctataatacacagctgtgtttgtttacagtccactgcaacattgtccctactgtctttaggatttttattagaggaaaacggggaattttcagtatcatccagcctattatatagtggatgcccactaaggccaacgcccaatggctgccccctacctatttcaacaccaacacaggcccataccatgcgctgtgtatctggattatataatgtagactcaggaacactaaatttattaggatcaggtaaggtaaccctaaacactctgtattgatatgcagacaccttaggaatgccctgcttgcggcccccagacataggaaccttaaaatatggatggcctacagttaataacctagatgtaccagcatagtaatacatgccagtgcgtgtcacataatcatctgtattgacaaccttcgccactgaggggggaggcaaatacaccatgttgtcgctagctcgccacaatgccat

SEQ ID NO: 16 - DNA, 11027 bp, Artificial Sequence
  Human papillomavirus type 73 template plasmid (X94165)
cagacgactgtgaaatagcatataaatatgcattattaggcaatgtagacagtaatgcagctgcatttttaaaaagtaatgcacaagcaaaatatgtaaaagactgtggtacaatgtgcagacattataaagcagcagaacgtaaacaaatgtcaatggcacaatggatacaacatagatgtgatttaactaatgatggtggtaattggaaagatattgtgctattcctaagatatcaaaatgtagaatttatgccttttttaattacattaaaacaatttttaaaaggtattcccaaacaaaactgtatagtattatatggaccgccagatacaggaaaatcacattttggaatgagtttaattaaatttatacaaggtgtagttatttcgtatgtaaattcaactagtcatttttggttatcacccttagctgatgcaaaaatggcattattagatgatgcaacacctggatgctggacgtacatagacaaatatttaagaaatgcattagatggtaatcctatatgtttagatagaaaacataaaaatttattacaagttaaatgccctccattactgataacatcaaatacaaatcctaaagcagatgatacttggaaatatttacatagtagaattaaggtgtttacttttttaaatccatttccatttgacagtaatgggaacccactataccaacttactaatgaaaactggaaagcattttttacaaaaacgtggtcaaaactagatttaacagaggacgacgacaaggaaaatgatggagacactgtgcaaacgtttaagtgcgtgtcaggacgcaatcctagaactgtatgaacgtgacagtgtacacctaagtgatcatattgatcattggaaacacgtgcgacatgaaaatgtattattacataaagcacgtgaaatgggactgcaaactgttaacaatcaagcggtgccaagccttgcagtatcacgatccaaagggtataatgcaattgaaatgcaaatagcactagaaagtttaaatgaatctttgtataacacagaggaatggacattgcaacatacaagttgggaactgtgggttacagaacctaaacaatgttttaaaaaggatggaaaaacagtagaggttagatatgactgtgaaaaggacaatagcatgcaatatgtattttggacacatatatattgttggtatgaaggggggtgggcaaaggtaggtagcaaaatagattataatggtatatattatgaaacagatgatgaggaaaaggtatactatacaagatttgatacagatgcaaaacggtacggggtaaaaggcatatgggaagtacatatgggtggtcaggtaatatgttgtgctcctgtatctagcgcctgtgaagtatccattcctgaaattgttaacccactgcacaccacaaccaccaacaccaccaccacctgcaccaacgttgacaccggtgtgccatcacggaaacggcaaagacagtgtgactcggaccagaggcccctggattgtttgcataacctacatcccaccacagagtcctgtacccagtgtactacacataatgttgcgccaatagtgcatttaaaaggtgacaaaaacagcttaaaatgttttagatatagattgcataaaggctattcacatttatttaaaaatgtaacaacaacatggcattggaccaatactacaaatagtaaatgtggtgtaataacattaatgtttacaactgtattgcaacaacaacattttttacaacatgtaaaaataccacaaactattgtagttacatcaggatacatgtctttgtaacattggttacacagtatatatgattctttgtatatttgtatttttgttttgtgttggcttttgtttgtgcttgtgtgtgtcgcttgcagtgtctgtgtatatttacccatggttattggtattgattataataacctttatacatgtatcacaatcattgttaaaagtattttttttatatgttttggtattttatattcctatggcacttgtacattaccatgctacattacaaataacataaacaattttacatatataataaactgcctaatatttttagtgtaccatgcgtcgcaagcgtgacacacacatacgaaaaaaacgtgcatctgcaacacaattatataaaacatgtaaacaagcaggtacgtgccctcctgatgtaattcccaaggttgaaggtagtactatagctgataatatattaaaatatggtagtattggagttttttttgggggattgggaataggtagtgggtctggatcaggggggcgtactggatacgttccattatctacaggcacaccatctaaaccagttgaaattccattacaacctatacgaccatcagttgttacgtctgttgggccttcagattcttctattgtttcattagtggaagaatcaagttttatagagtcaggtatacctggtcctacatctatagtgccttctacttcagggtttgatattacaacttctgtaaacagtacacctgctattatagatgtatctgctattagtgatactacacaaatatctgttacaacatttaaaaatccaacctttactgacccatctgtgttgcaacctcctccacccttagaagcctctggcagacttttattttcaaatgacactgtaactacccattcatatgaaaatatacctcttgacacatttgtagttacaacagaccacaatagtattgttagtagtacgcccatcccagggaggcaacctgctgcacgcttaggattatatggacgtgcaatacaacaggttaaggttgtagaccctgcgtttttaactacgcctacacgtttagtaacatatgacaaccctgcctttgaaggcctgcaggatacaacattagagtttcagcacagtgacttgcataatgctcctgattctgattttttagatattgtaaaattacataggcctgctttaacctctagaaaaacaggcatacgtgttagtagattgggacaacgtgcaacactttctactagaagtggcaaacgtataggtgctaaagtacatttttatcatgatataagtcctatacctactaatgatattgaaatgcaacctttagttacaccacaaacacctagtatagtaactggtagtagtattaatgatgggttatatgatgtgtttttagacaatgatgtagaagagactgtactacaacaaacatatacacctacaagtatacatagtaatagtttagttagtagtgatatttctactgcaactgcaaatacaactattccttttagtactgggttagacacacatcctggtccagatattgctttaccactaccttctacagaaactatttttacaccaatagtgccattacagcctgctggtcctatatatatttatgggtcaggttttatattacaccctagttattatttgttaaagcgcaaacgtaaacgtctgtcatattcttttacaggcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtaccgggccccccctcgagatgtggcgacctactgatgcaaaggtatacctgccccctgtgtctgtgtctaaggttgtaagcacagatgaatatgtaacaagaacaaatatatattattatgcaggtagcacacgtttgttggctgtgggacacccatattttcctatcaaggattctcaaaaacgtaaaaccatagttcctaaagtttcaggtttgcaatacagggtgtttaggcttcgtttaccagatcctaataaatttggatttccagatgcatccttttataatcctgataaggagcgcctagtatgggcctgttctggtgtggaggttggacgtggacaacccttaggtataggtactagtggcaatccatttatgaataaattagatgatactgaaaatgctcctaaatacattgctggacaaaatacagatggtagagaatgtatgtcagtggattataaacaaacacagttgtgtattttaggttgtaggcctcccttaggggaacattggggtccaggcacgccatgtacttcacaaactgttaatactggtgattgtcccccactggaattaaagaacacccctatacaggatggtgatatgatagatgttggctttggagccatggattttaaagctttacaagcaaataaaagtgatgtacctattgatatttctaacactacctgtaaatacccagattatttaggcatggctgctgatccctatggtgattccatgtggttttatcttcgtagggaacaaatgtttgttcgacacttatttaacagggctggtgataccggtgataaaatcccagatgacctaatgattaaaggcacaggcaatactgcaacaccatccagttgtgttttttatcctacacctagtggttccatggtttcttcagatgcacagttgtttaataaaccttattggttgcaaaaggcacagggacaaaataatggtatttgttggcataatcaattatttttaactgttgtagatactactagaagcactaatttttctgtatgtgtaggtacacaggctagtagctctactacaacgtatgccaactctaattttaaggaatatttaagacatgcagaagagtttgatttacagtttgtttttcagttatgtaaaattagtttaactactgaggtaatgacatatatacattctatgaattctactatattggaagagtggaattttggtcttaccccaccaccgtcaggtactttagaggaaacatatagatatgtaacatcacaggctattagttgccaacgtcctcaacctcctaaagaaacagaggacccatatgccaagctatccttttgggatgtagatcttaaggaaaagttttctgcagaattagaccagtttcctttgggaagaaaatttttattacaacttggtatgcgtgcacgtcctaagttacaagcttctaaacgttctgcatctgctaccacaagtgccacacctaagaaaaaacgtgctaaacgtatttaataagtgtaatgtgtatgtgttgtttgttgtatgttacatgtgttttgtatgtttgtttgttgtatgttaactgtttactaatactgtgtgtatgtttatgtacatgtgtataactgtttgtttatatatatgtatgtatttgtgtgtatgtgtatgtgtatgtgtatgtgtagtaatgtttgtatgtatgtttaataaagtttatatgtgtgttgtgtgggtggtttacttgactactgtgcttccattttgtatagtcgccattttacatgcattaaggtaaaaagggcaaccgatttcggttgcacagtaaaacatgttttaatgtgttttgctgttgtagcaaaatagttgtactgtttttggcttcctgcaggcaacttggcagggtttgtttccttaacatgttcatcccacgcaaggttataaaggtaaaaggcgccacctggcagttactcatttgtctgcaattatttaaacaatgtcttgcacacacattttttacccaccctatcataaaattgcttttaagcacatacctatactatgtacacagtgtactcttggcagaacattgttttttaaatgccaagtaattgttttataaatgagtaataacgtgttactcatactgcacctaaaaagttaaacctatttggatcacacaaatgccaatttatttcttattacaaataactataatgtactattaaaaaaaagggtgtaaccgaaaacggtttcaaccgaaatcggtgcatataaaagtaggaaagcaaaaaacgctacagattgggaaatgctgtttcccaattcagaagaacgaccatacaagctacaagcgttatgtgacgaagtgaatatttctatacatgatataaacctggactgtgtgttttgccaacgtggactgtacagatctgaggtatatgattttgcatttagtgatttgtgtattgtatatagaaaggataaaccatatggtgtatgtcaaccgtgtttaaaattttattctaaaattagagagtataggcgatatagacaatcagtatatggcactacgttagaaaatttaactaacaaacagttatgtaatattttaataaggtgcggaaaatgccaaaaaccattatgtccactggaaaagcaaaagcatgtagatgaaaaaaaacggtttcatcaaatagcagaacagtggaccggacgctgtacacggtgctggagaccatctgcaactgtggtgtaagatgcatggaaaaaaaacaaccttgcaggacattactttagacctgaaaccaacaaccgaaattgaccttacatgttacgagtcattggacaactcagaggatgaggatgaaacagacagccatctagacagacaagctgaacgagagtgttacagaatagttactgactgcacgaagtgtcagtgcacagtatgccttgccattgaaagcaacaaagctgatttaagagtgatagaagagttgcttatgggtacactaggtattgtgtgccccaactgttccagaaacctataaaagaagatggctgattcaggtaattgggaagggaggtgtacgggatggtttaatgtagaagccattgtagaaagaaaaacaggggatccaattccagaggatgaaaattatgatggaggggatacagatgagtcggaaatgggggattttattgataatgcacatataccaaatatatatgcacaacaggaaattgcacaggcattgtatcagtcacagcaagcaaatgcagacaatgaggctatacgtgttctaaaacgaaagtttacaggtagtcctggcggtagcccagatatgaaaagagatgaattcatagacaaacagcttagtccacaaataaatgtattgtcaataagtagcggtagaagtacatctaaacgaagactgtttgaggagcaggacagtggatatggcaatactgaagtggaaacttacgagacagaggtaccgggacttggggcaggggtagggtgtttacaaaatgttaatgaagaaggcaaccaaattgtgtcgccacgtgaaagcagtagtgggtccagtagcatttcaaatatggatatagaaacagagagcacacctataacagatattacaaatttattacaaaggaataatgcaaaagcagcattgctagcaaaatttaaagaagtatatgggttaagttatatggaattagttagaccatataaaagtgataaaacacattgccaagattgggtgtgtgctgtgtttggtgtaataccctcacttgcagaaagtttaaaatccttactaacacagtattgtatgtatatacatttgcagtgtttaacatgtacatggggcataatagtgttagtattagtaagatttaagtgcaataaaaatagactaacagtgcaaaaattattaagtagtttattaaatgtaacacaagaacgcatgttaattgaacctccaagactacgaagtacaccatgtgcattatattggtatagaactagtttatcaaatattagtgaaatagtaggagacacacctgagtggattaaaagacaaacgttagtgcagcatagtttagatgatagtcaatttgacctatctcaaatgatacagtgggcatttgataatgatataacagacgactgtgaaatagcatataaatatgcattattaggcaatgtagacagtaatgcagctgcatttttaaaaagtaatgcacaagcaaaatatgtaaaagactgtggtacaatgtgcagacattataaagcagcagaacgtaaacaaatgtcaatggcacaatggatacaacatagatgtgatttaactaatgatggtggtaattggaaagatattgtgctattcctaagatatcaaaatgtagaatttatgccttttttaattacattaaaacaatttttaaaaggtattcccaaacaaaactgtatagtattatatggaccgccagatacaggaaaatcacattttggaatgagtttaattaaatttatacaaggtgtagttatttcgtatgtaaattcaactagtcattttggtatcaccctta

SEQ ID NO: 17 - DNA, 7871 bp, Artificial Sequence
  Human papillomavirus type 82 template plasmid (AB027021)
atactttacaattatcttgtaaaaagtagggtgtaaccgaaaagggttatgaccgaaaacggtgcatataaaagcaagcacgaaaaatacataagaacaccatgtttgaagacataagagaaagaccacgaacgctgcacgaattatgtgaagcctgcaatacgtctatgcacaatattcaggtattgtgtgtatattgtaaaaaggagttgtgtagagcagatgtgtataatgtagcatttacagaacttaggattgtatatagggacaatacgccatatgcagcatgcaaaaaatgcctaatgttttattctagaattagagaatacagaaggtatagtaggtctgtgtatggtgctacattagaggccattactaacaaaagtttatatgaattattaataaggtgtcatagatgtcagagaccacttgggcctgaagaaaagcaaaaggtggtggacgacaaaaaaaggtttcatgaaatagcgggacgctggacgggacagtgtgcaaattgcagaaaaccaccaagacaacgtagtgaaacccaggtgtaataacgccatgcgtggtaatgtaccacaattaaaggacatagtgttggagttaacaccacaacctgaaattgacttgcaatgctacgagcaatttgacagctcagacgaggaggatgaagtagataatatgcgtgaccagccagccagacaagctggacaggatacgtgttacagaattaaagtgcactgttgcaggtgttcgagtgttgtacagctcgcagtggaaagcagtggagacagccttcgcatatttcagcaaatgttactgggcgacctaagcctggtgtgcccgtggtgtgcgaccaactaacatcggcaatggacagtgaaggtacagaggatgagggggcggggtgtaccgggtggttttatgtggaggcagtagttgacaaaaaaacgggagataatatatcagacgatgaggaggaagatacaaatgatacagggtctgatataatagattttatagatacaagtaatagtatttgtagtcaggcggaacgggagacagcacaggcgttgttgcaggtccaagaaacacaggcacacaaagaggctgtgcagcatctaaaacgaaagtttctaggcagtccgcggagcagcccattaaaagacattacaaatcaaaacacacaaagcaatagtcagcaacaaccaaaacaggcaaaccttcaacacggtaaaaggagattactggacagttatccggacagtggatatggcaatacacaagtggagactgtggaaggacccttacaggtagatgggcaaaatgacgggtcacaacatagtatgtgtagtggcggggggagcagcgacagaagtacagagatagacctggaaacaaacgaaaatgctaccaatgtaggactaaacagtatatgtgcagtgttaaaatgtagcaatgcaaaagcaatgtttatggcaaaatttaaagaactgtatggtgttagttataatgagttggtaagggtatttaaaagtgataaaacatgctgcacggactgggtatgtgccttatttggggtatcgccaatggtggcagaaaatttaaaaaccctaattcagccattttgtatgtactaccatatacaatgcctatcatgtgattggggtactattgtgctactgttagctagatttacatgtgccaaaaacagacttaccattgccaaatgtttaggtacattagtaaatattccacaatcacaaatgtttatagaaccacctaagctacgtagtacagccgttgcattgtacttttatagaacaggaatatcaaacattagtagcacatatggcgaaacaccagaatggattacaagacaaacacaactacagcacagttttgatgatagcacgtttgaactatcgcaaatggtacaatgggcatttgaccatgatgtagtagacgatagtgaaatagcattttactatgcacaattggctgatacagatagcaatgcagcagcgtttctaaaaagtaattgccaagcaaagtatgtaaaagactgtgggactatgacacggcactacaaacgagcacaaagaaaatcactaacaatgtcagcatggattaggtatagatgtgacaaagtgcaagacgggggtaactggagggaaatagctaaatttttgcgataccagggtattaactttatgtattttatacaaacatttaaattgtttttaaaaggaacaccaaaacacaactgcatagtaatacagggcccaccaaacacagggaaatcacaatttgcaatgagtttaattagatttttgcaagggtgcgttatttcatatgtaaattcaggtagtcatttttggttacagccactagaggatgccaaggtagcattattagatgatgccacatatggctgttggacatatatagaccagtacctaagaaatttcctaaatggtaatccatgtagtattgataggaaacacagaagcctgctgcaaattgtatgcccaccattgcttattacctcaaatatcaatccaaaagaagatccaaatttaatgtatttacatagtagagtgacagtatttcaatttttaaatgcatttccatttgacccccatgggaatcctgtatatgcactaaatgatgtaaactggaaaaattttttttccaccacctggtccagattagatttggaggaggaagaggacaaagaaaatggagaccctatgtcatcgtttaaatgtgtgccaggagaaaatactagactgttatgaactggacagtgataaattagtagatcaaattaattattggacgttggtacgatatgaatgtgctatgttttatactgcacgagaaagaaacatgcaaacccttaaccatcaagtagtaccagcatcggcagtatcaaaacaaaaggcctgccaagccattgaaatgcatatggcattagaatcgctaaacaaatctgaatataatatggaaccatggacaatgcgggacacatgctatgaactatggggcgaggcccctaaacattgtttcaaaaaagggggaaaaactgtaacagtgatgtttgatgggaataaggacaatacaatggactatacatgttggacatatgtgtatatatataaagaggatagatgggtaaaaacacagggaaacgtggactatacaggtatttattacaaaccagatgtaaacaaagaatattatgtaacatttaaagatgaagcaaaaaaatatggggcacaacaatgggaggtatatatgtgtggcaatgtaataacatgtcctgaatatgtatctagtacctacagcaccccgtcaccctctactacaactgttgaacagctatcgaacacccccacgaccaatacctattccgcctccgcgggcaccacagaagcccagacaccacaacaacgaaaacgacagcgacttgctgagcccgactcctccacagtcaccccgctgtccgtggacacctgcgaccaccaaatacactgtggaactgcaggcccaaacaccggagggcacctcagtgcaactaaaactgcgtttatagttcatttaaaaggtgcaacaaattgtttaaaatgtttaagatacagatttgcaaaacatagaaatttgtttaaagaagtgtcatctacctggcattggaccagtaatacaaaagcaggcattgttacaattacatttgacagtgcacaccaacgtcaaaagtttattgatactgttaaagtaccatcaagtgtgacagtgtcattgggtattatgacagtgtaaatatatgtattgtacatatataggtttacaagccaatatgtgctgctaagtgtatatagttactcgcaaccattgcggtgtttttggtgtgtttatttgtgctttgcgtgtgtgtgtgtcttgtgttgtgttgtttgttgccgctattgcaatcccaatatgtgtttgcagcagccttattactaattatatgtttttggtttgtggttgccacatcacctttaactacatttactgtatacttgatttgtttttatattccatgctttttattacatttatataccttttctattttgcaacttacacaataaaactttgtatgtttttgtattatatacaatggtggctgcacgtgcacggcggcgtaagcgagcatctgtaacacaattatattccacatgcaaagctgctggtacatgtcctcctgatgttattcctaaggtaaagggcactacattagctgataaaatattacaatggagtggtttgggtatatttttggggggtttgggtattggcaccgggtctggcactgggggcagaactgggtacattcctttaggtggtggtggacggcctggtgttgtagatattgctccggccaggcctccaattattattgaacctgtagcccctactgaaccttctattgttaaccttgttgaggattctagtattattaattcaggctctactatacctacctttactggtactgatggctttgaaattacttcctcttctacaacaactcctgcggttttagacattacaccttccgctggtacagtacatgttacaagcactaacattgaaaatcccttatatattgaacctccatttattgaggcaccacaatcaggtgaggtatctggacatatatttaccagtacccctacgtctggcacccatggatatgaggaaatacctatggaggtatttgcctccaatgttactactggtaaggaacccattagcagtacacccacccctggggtgcgccgcattgctgcacctcgtttatatagcagggcattttcacaggttaaggttactaatccagactttattagtaagccctctacatttgttacttttgataatcctgcttttgaacctgctgatacatcattgtcctttgaggaacctactgatgttgcaccagatcctgattttttagatattattaaactgcaccgccctgcgctgacatctcgcagaggtacagtgcggtttagtagattgggtcaaaaggccaccatacgcacacgtagtggcaaacaaataggtgctcgtggacattattatcatgatataagtagtattgcacctgctgaggaacttgaaatgcagcctttactttccccttctactaataattatagttatgacatttatgctgatttaaatgaagctgaaacaggttttatgcagcctacacaaaccacacctatgcttcgctctccattttctcctttgtctacacaactaccttcattgtcttcctctgtttcttcatcttatgctaatgttactatccctttttctaccacatataatgttcctattcatacgggtcctgatgttgtgttacctacttcacccactgtgtggccctttattccacacacatctattgacacacaacatgctattgttatacaaggtggggattactactttgtggccgtatacatatttgttacgcaaacgccgtaaacgtataccctatttttttgcagatggctttgtggcgtactaatgacagcaaagtgtatttaccacctgcaccagtgtcacgcattgtcaacacagaagaatatataacccgcaccggcatatattattatgcaggcagttccagacttattaccttaggacatccatatttttcaatacccaaaaccaatacacgtgctgaaatacctaaggtatctgcctttcagtatagggtgtttagggtacagttacctgaccccaacaaatttggtcttcctgatcctaatttgtttaatccagacacagatcgtttggtgtggggatgtgttggtgttgaagtaggtaggggtcagccgttaggtgttggccttagtggtcatcctttatttaataagtatgatgatactgaaaactctaggtttgccaatggcaacgaccaacaggatgttagggacaacatatctgtggacaacaaacaaactcagttatgcattataggctgcgctcctcctattggggaacactgggccacaggtaccacatgtaaaaacgtacctgtacctcagggtgactgtccacctttggaacttgtgtctactgtcattgaggatggcgatatggtggacactggttttggggccatggattttgctaatttacaagctactaaatcagatgttccattggatattgctcagtctgtgtgtaaataccctgattacttaaaaatgtcagcagatacatatggcaattctatgttttttcatttacgcagggagcaaatatttgctaggcattactataataaggctggtgtggttggtgatgccattccagacaaggcttatattaagggtactggtgctggccgcgaccctattagtagttatatttattcagctactcccagtggttctatgataacctctgattctcagatttttaataagccttattggttgcatcgcgcccagggccacaataatggcatttgctggaataatcagctttttattacttgtgttgacactactaaaagtaccaatttaaccattagcactgctgttactccatctgttgcacaaacatttactccagcaaactttaagcagtacattaggcatggggaagaatatgaattgcaatttatatttcaattgtgtaaaatcactttaactactgaaattatggcttacctgcacaccatggattctacaattttagaacagtggaattttggattaacattgcccccctccgctagtttggaggatgcctatcgatttgtaaaaaatgcagcaacatcctgtcacaaggacagtcctccacaggctaaagaagaccctttggcaaaatataaattttggaatgtagaccttaaggaacgcttttctttggatttggatcagtttgcattgggtcgcaagtttttattacaaatcggtgcccaacgcaaacccagaccaggccttaaaaggcctgccccatcctcttccgcttcctcgtctgccaaacgtaaaagggttaaaaaataggttcgccctgcctatgtatgtgtttgtgtgtgtgtgtgtgtgtgtgtgtgtgcgtgttgtgtgtatttgtgtgtgtatgtttatgtatatttttctgtatgttttgctgtatggtttctgtgtggtttactaataaagtatgtatgtgtgtgtgtttttgcaatgtgttgtgtttttgcatgactgcatatgtatgacataaaaaagtgtttgtaataattacattatccctgtaggttaagggtggtgtttaggtggcgtccctattgccctacccatatttgtggcttgcagcacacttgtatatatatgttcttgctgtattgcatgtaccacaggattccattttgttttttcctgcagccattttgtggcgaccgatttcggttgcttaaaaatgactacatttgccaacttttgaaccacactacctatgttttttggcataacccttaattcttttggcatggtatgtacatcccgcccgcccacgccttgttcctggcgcgccttcctggcgcatgtcatacacaccacattactcatttgtacttaaacaattgttggcacaatatttttccgccctgtaataatttatatgcttataggcatgtattttttggcttattttgcctttattaattgcatacttggcaggtcatgaactaaatgtctctgccaagtttctatcctacctataaaatgtattactcatctgcaggtgtgctacacaactgtgttacccaaccgatttgtgttttgcctatgcttgcaacattttttcttata

SEQ ID NO: 18 - DNA, 7815 bp, Human papillomavirus type 1
gttaactaccatcattcattattctagttacaacaagaacctaggagttatatgccagaagtaagcctataaaatacacaggtaagactctgcacaggaccagatggcgacaccaatccggaccgtcagacagctttccgaaagcctctgtatcccatatattgatgttttattgccttgtaatttttgtaattattttttgtctaatgctgagaagctgctttttgatcattttgatttgcatcttgtctggagagacaatttggtgtttggatgctgtcaagggtgtgctagaactgttagcctattggagtttgttttatattatcaggagtcttatgaggtaccggaaatagaagaaattttggacagacctttattgcaaattgaactccgttgtgttacatgcataaaaaaactgagtgttgctgaaaaattggaggttgtgtcaaacggagaaagagtgcatagagttagaaacagacttaaagcaaagtgtagtttgtgtcgcttgtatgctatataacaatggtgggcgaaatgccagcactaaaggacctggttcttcaacttgaaccaagcgtcctagatttagatctttattgttacgaggaggtgcctcctgatgacatagaggaggagttagtgtcgcctcagcaaccttatgctgtcgttgcttcctgtgcctattgcgagaaactggttcgattgaccgtcctcgcggatcacagcgccattagacagctggaggaactccttctgcgatctttgaacatcgtgtgcccactgtgcaccctacagcgacagtaaaatggcagataataaaggtactgaaaacgattggtttttggtggaggcgacagattgtgaggaaacgttagaggaaacctcacttggtgacctagataatgtttcttgtgttagcgacttatctgatttattagacgaggcgccgcaaagccaggggaattccctggaattgttccacaagcaagaatcgctggaaagcgaacaggaacttaatgctttaaaacgaaagttactttacagtcctcaggcgagaagcgcggacgaaacagacattgctagcattagtcctagattagaaactatttctattacaaagcaagacaaaaaaaggtatcgaaggcaactgttttctcaggatgatagtggtttagagctatcgctgcttcaggatgaaactgaaaatattgatgaatcgacacaggtagatcaacagcagaaagaacatactggggaagttggggccgctggggtgaacattttgaaagctagtaatatccgcgccgcattattaagcagatttaaagatacggctggcgtcagttttacagacctgacgcggtcgtacaagagcaacaaaacctgttgtggagattgggttttggcagtttggggtgtccgtgaaaatttaattgacagtgtaaaagaattattgcaaacccattgtgtgtatattcaattggaacatgcagtaactgaaaaaaatagatttttatttttattggtacgatttaaagcccagaaaagtagagagactgtgataaaacttataaccacaattcttccagttgatgctagctatattttgtctgagcctccaaaatcaagaagtgtggctgctgcattattttggtataaaagatctatgtcttcaactgtttttacatggggtacaactttggagtggattgcacagcaaacccttattaatcatcagttagattccgaaagtccctttgagctttgtaaaatggttcagtgggcctatgataatggacatacagaagagtgtaaaattgcatattattatgctgttttagcagatgaggatgaaaatgcaagggcatttctaagctctaattcacaggcaaaatatgtgaaagactgtgcacaaatggtaagacactatttacgtgctgagatggcacaaatgtctatgtcagagtggatttttagaaaactagataatgtagaaggttctggtaattggaaagaaattgtaagatttttaagatttcaagaagttgaatttataagctttatgattgcatttaaagatttgttatgtggtaagccaaagaaaaactgtttgttaatatttggacctccaaatacaggaaaatcaatgttttgtacaagtttattaaagttgttaggagggaaagtgatttcatactgtaacagtaaaagtcagttttggttgcagcctctggctgatgctaagatagggctattagatgatgcaacaaagccatgttgggattatatggacatttatatgagaaatgcattggatggtaacactatttgtattgatttaaaacatagagctcctcaacaaattaaatgcccacctttacttattactagtaatattgatgttaaatcagatacctgttggatgtatttgcatagtagaatatcagcttttaaatttgctcatgagtttccatttaaagacaatggtgatccaggattttccttaacagacgaaaattggaaatctttctttgaaaggttttggcaacagttagaattaagtgaccaagaagacgagggaaacgatggaaaacctcagcagtcgcttagacttactgcaagagcagctaatgaacctatatgaacaggacagtaaattgatagaagatcaaattaagcagtggaatctaattagacaagaacaagttcttttccatttcgccagaaaaaatggggtaatgagaattggattgcaggcagttccatctttagcgtcctcacaggagaaggcaaagacagctattgaaatggtgttacatttagagtctttaaaggactcaccttatggcacagaggattggtcacttcaagacactagcagagagctgtttttggcacccccagctggcaccttcaagaagagtggcagcacacttgaggttacctatgacaataaccctgataatcagacaaggcacacaatttggaatcatgtgtattatcaaaatggggacgatgtatggagaaaagtatccagtggtgttgatgctgtaggagtgtactatttagaacacgatggctataaaaattattatgtgttatttgctgaggaggcctctaagtacagcacaacaggacaatatgctgtaaattacaggggtaaaaggtttacaaatgttatgtcttccactagctccccaagggctgctggggctcctgcagtacactccgactacccaaccctatccgagagtgacaccgcccagcaatcgacgtccatcgactacaccgaactcccaggacagggggagacctcgcaggtccgacaaagacagcagaaaacacctgtacgcagacggccttacggacggcgaagatccagaagtcccagaggtggaggacgaagagaaggagaatcaacgccctctaggacacccggatctgtcccttctgcgcgagacgttggaagtatacacacaacgcctcaaaagggacattcttcaagacttagacgacttctgcaggaagcttgggatccacccgtggtctgtgtaaaagggggtgccaatcagcttaagtgtctcaggtacagacttaaagcatctactcaagttgactttgacagcataagcaccacatggcattggacagatagaaaaaacaccgagaggataggtagtgctagaatgttagtaaagtttattgatgaggctcaacgagagaagtttcttgagagagttgctttgcccagatcagtgtctgtgtttttgggacagtttaatgggtcttaaaattaatggaagttgattttgcttggacgtgtgtacatagtccctgtatatattcccctcctacccccacataccttgaagcttgcaacattgtaacaaatgtatcgcctacgtagaaaacgcgctgcccccaaagatatatacccctcatgcaaaatatcaaacacctgcccacctgacattcaaaataaaattgagcatacaacaattgctgataaaatattgcaatatggcagtctgggagtttttttgggaggtttgggcattggaacagccagaggctctggaggaagaattggttatactcccctcggtgagggtggtggggttagagttgctactcgtccaactccagtaaggcctacaatacctgtggaaacagtaggccccagtgaaattttccccatagatgttgtagatcctacaggccctgctgttattcccctacaagatttaggtagagacttcccaataccaactgtgcaggttattgcagaaattcaccctatttctgacataccaaacattgttgcatcttcaacaaatgaaggagaatctgccatattagatgtgttacgagggaatgcaaccatacgcactgtttcaagaacacaatacaataacccctctttcactgttgcatctacatctaatataagtgctggagaagcatcaacatcagatattgtatttgttagcaatggttcaggtgacagggtggtgggcgaggatatccccttggtagaattaaacttaggccttgaaacagacacatcttctgttgtacaagaaacagcattttccagcagcacaccaattgctgaaagaccctcttttaggccctcaagattctataataggcgtctatatgaacaggtgcaagtacaagaccctaggttcgttgagcagccacagtcaatggtcacttttgataatccagcatttgagccagagcttgatgaggtgtctattatcttccaaagagacttagatgctcttgctcagacaccagtgcctgaatttagagatgtagtttatctgagcaagcccacattttcgcgggaaccagggggacggttaagggttagccgccttggcaaaagttcaactattcgtacacgcctgggcacagcaattggcgccagaacccactttttctatgatttaagttctattgctccagaagactcaattgaattattgcctttaggtgagcatagtcaaacaacagtcattagttccaacttaggtgacacagcatttatacaaggtgagacagcagaggatgacttagaagttatctctttagaaacaccacaattatattcagaagaagagcttttagacacaaacgaaagtgtgggcgaaaatttgcaacttactattactaactcagagggtgaggtttctatactagatttaacacaaagcagagtcaggccaccttttggcactgaagatactagcttgcatgtatattacccaaattcttctaaagggactccaataattaatcctgaagaatcatttacacctttggttattatagctcttaacaactcaacaggggattttgagttacatcctagtcttagaaagcgtcgtaaaagagcttatgtataatgtttttcagatggctgtctggttaccagcgcagaataagttctatcttcctccccagcccatcactagaatcctgtccactgatgaatatgtaaccagaaccaatctcttctaccatgcaacatctgaacgtctactgctggtcggacatcctttgtttgagatctccagtaatcaaactgtaactataccaaaagtgtcaccaaatgcatttagagtttttagggtgcgttttgctgatccaaatagatttgcatttggggataaggcaatttttaatccagaaacagaaagattagtttggggcctaagagggatagagataggtagaggccagcctttaggtataggaataacgggccaccctcttttaaataagttagatgatgcagaaaatccaacaaattatattaatactcatgcaaatggagattctagacaaaatactgcttttgatgcaaaacagacacaaatgttcctcgtcggctgtactcctgcttcaggtgaacactggacaagtagtcgttgcccaggggaacaagtgaaacttggggactgccccagggtgcaaatgatagagtctgtcatagaagatggtgacatgatggatattggttttggggctatggattttgctgctttacagcaagacaagtctgatgtccctttagatgttgttcaagcaacatgcaaatatcctgattatatcagaatgaaccatgaagcctatggcaactctatgtttttttttgcacgtcgcgagcaaatgtataccaggcacttttttactcgcgggggttcggtgggtgataaggaggcagtcccacaaagcctgtatttaacagcagatgctgaaccaagaacaactttagcaacaacaaattatgtaggcacaccaagtggctctatggtttcatctgatgtccaattgtttaatagatcttactggcttcagcgatgtcaaggccagaataatggcatttgctggagaaaccagttatttattacagttggagataataccagaggaacaagtttatctatcagtatgaaaaacaatgcaagtactacatattccaatgctaattttaatgattttctaagacatactgaagaatttgatctttcttttatagttcagctttgtaaagtaaagttaactcccgaaaatctagcctacattcatacaatggaccctaatattttagaggattggcaactatctgtatctcaaccacctaccaatcctctagaagatcaatataggtttttagggtcttccttggcagcaaaatgtccagaacaggcgcctcctgagccccagactgatccttatagtcaatataaattctgggaagtcgatctcacagaaaggatgtccgaacaattagaccaatttccactaggaaggaaatttctatatcaaagtggcatgacacaacgtactgctactagttccaccacaaagcgcaaaacagtgcgtgtatctacgtcagccaagcgcaggcgtaaggcttagtatatattatatataactatatttattagtagattatttattatatatttttatatttttatactttttatacttgtttagttctaaatagacatgtaagatttacattagtataagtaggcatgtatttacataaaatagtcttggaaaccttttattagtgaaccatcatttacaatagtgacatcatagttcatctgcaattgctattccatcgttcttcacatattctacagtagtgttctctagattgtattgctattttcctgttaggcaaacaacaacatctgtacatggaccaaacaacccactttcattttattgtgctgcatatattccagattgttgaggatttatttgtttagactccggtgcattatacacaagtgtgcattttttgtgttctctgattgattgtgtgttattttcctgcaatatgcaataaaagtgagctgtcctttctttttgttaatccctccctactccaataaaaaatccctacccctaaaatctgtttgtgctggttttattaataattgcgctcttttatataataagtactattaacaccgcacccgttgtggctaatcccttatggtatttaaaagactacacctacaggatgtattgtcttcattgtttatggtttaccgcgctccaaagacggtttgcccaaagacggtttgccaaccgcggttaggacttgtttcaatttgctgccaaacttatctggtcgtgctccaacgggtttcctgccaagcacctaaaacggtaggtgtgtactcttttcaagaattaacaaaggagatttctcccgccaaattagtttcgagcgaccgaattcggtcgtaaaaatctaaagtgatgattgttgtt

SEQ ID NO: 19 - DNA, 7860 bp, Human papillomavirus type 2
ataatgtataactataatcctttatttaaaaatagggtgtgaccgaaaacggtcagaccgaattcggttgtatataaacagaagcaggatgcacacaagggcagggatgtctgaggagaatccatgccctaggaacatctttttgctttgcaaagagtatggtttggagctagaggatttgcgattgctctgtgtatggtgcaaacggccgttatcagaggctgacatatgggcatttgcaataaaagaactgtttgtagtgtggagaaagggcttcccatttggagcctgcggaaaatgcctgattgcagcaggaaaacttagacaatacagacattggcattactcatgctacggagacacagtggagactgagacaggaatacccatacctcagctgtttatgagatgctatatttgccataagcccctgagctgggaggagaaggaggcattactagttggaaacaagcgtttccacaacatatcaggccggtggacgggacattgcatgaactgcgggtcatcatgcacggcaaccgacccagcctcaaggacattacactaatattggatgaaatacccgaaattgttgacctacattgcgacgagcaatttgacagctcagaagaagagaataaccatcaactgacagaaccagatgtgcaggcctacggggtggtaactacctgctgtaagtgtggcagaaccgtccggctggtggttgagtgcggacaagcagacctaagagagctggaacagctgttcttgaagacgctgactctagtgtgccctcactgcgcctagcgttatggaggattccgaaggtaccgacgggaccgaggaggacgggtgccgggcaggggggtggtttcatgtggaggccattataacacacggccagaggcaggtatccagtgacgaggacgaggacgaaacagagacaggggaggatttagactttatagacaatagggttcccggagatgggcaggaaattcccttgcagctatatgcacaacaaaccgctcaggatgacgaagcaacagtgcaggccctaaaacgaaagtttgtggccagtcctttgtctgcatgctcatgcatagagaatgatttaagtcccagattagatgcaatctccctaaacagaaagtcagaaaaggcgaagaggcgcttattcgagacagaaccaccagacagtgggtatggcaatacgcagatggttgttggaacgccagaggaggtaacgggggatgaggaaagccaaggggggcggccggtggaggatcaggaggaggagcgtcaagggggagacggagaggcagatctaactgtacacactccacagtcaggaacagatgcggcgggtagcgtgctgaccttactaagaagtagcaatctgaaggcgacgttgctgagtaagtttaaggacctgtttggggtgggattctatgaactggtcagacagttcaaaagcagcaagacagcatgtgcagactgggtcgtctgcgcctatggtgtgtattatgctgtagcggagggtctaaagaaattaatacagccacatacacaatatgcacatatacaggtacagaccagctcgtggggcatggtggtctttatgctgctgcgatacaactgtgcaaaaaacagggactcagtgtccaagaacatgagcatgctgctaaacattcccgaaaagcatatgctcatagaaccaccaaaactgagaagtacccctgccgccttatactggtacaagacggccatgggcaacggaagtgaggtatatggggaaacaccagaatggattgttagacagacgttggtaggacatagcatggaagacgaacagttcagactgtcagttatggtacagtatgcatatgaccatgacattgtagaggaaagtgtgcttgcatttgagtatgcacaactagcagatgtggatgccaatgcagcagcatttctaaacagtaactgtcaggccaagtacgtgaaggacgcagtgacaatgtgcaggcactataagcgtgcagagagagaacagatgagtatgtcacagtggataacattcagaggaaataaggtatcagaggaaggggactggaagcccatagtcaggtttctaagacatcaaggggtagagtttgtgtcgttcctagctgcctttaaattgttcctaaaaggcgtgccaaagaaaaattgtatagtgttctatggacctgcagacacaggcaaatcatatttttgcatgagcttgttgcagttcctaggcggcgctgttatctcatatgctaattctagcagccatttttggcttcaacctttatcagatagtaagatagggttactggacgacgcaacaccccagtgttggagttacatagatatatatttaagaaatcttttggatggacacccagtgagcatagacagaaagcacaaaactttgctgcagcttaagtgtccacccctaatgataacaaccaacaccaatcctctagaggaggacagatggaaatatttgcgcagcaggctgacagtgtttacatttaagaatccatttccttttgcaagtccgggagagcccctgtacccgataaataatgcaaactggaaatgctttttccaaaggtcgtggtcccgcttagacctaaacagtccagaggagcaggacgacaatggaaacactggcgaaccgtttagatgcgtgccaggagacgttgctagaactgtatgaaaaggatagcaacaaacttgaggatcagattaagcattgggcgcaggtccggctagaaaatgtcatgctgtttaaggcccgagaatgtggaatgacacgagtcggctgtacagctgtgcctgccctcaccgtgtcaaaagctaaggcatgtcaggccatagaggtacagctggcattacagacattgatgcagagtgcctatagcacggaggcatggaccctacgagacacgtgtctggagatgtgggacgcacctccaaagaaatgctggaaaaaaaaaggacaatcagtattagtgaaatttgatggcagcagtgacagagacatgatatatacaagctggggattcatttatgtgcaggacactatcactgattcctggcataaggtgccagggcaggtggacgaactgggattatattatgtgcacgatggtgtacgtgttaactatgtggactttggaacagagtccttgacctatggggtcaccgggacgtgggaggtgcacgtggctgggactgttattcaccatacatccgcatctgtgtctagcacccaggccagcgcctcggacgacgaaccactatcccctattagaactgctgtatccccagtcccagccccagtcgcagcctcagcagaatcaacaggagcaggaagagcagctccgcccacccaagcgttgtgctccgcccaggcgccaacgagtccgccggccaagcgccagcgtgtcatcgtcggacagcagcatccccggcccgactctacgcgaacggtcggagagggggaagtggagtgttacaacaagcggagcatcagtgactctaaccgcacagaccccaggtggggccacggtgacactgactctgtgcctgtaatccacctgagaggtgatgcaaattgtttaaagtgcttcagatacagggtgcaaaaacataaagacgtactgtatgccagggtgtcctccacgtggcactgggcgggtgggaacggtgataagacagcctttgtaacactgtggtacaccagcgttgaacagcgtacagagttcctgacaagagtcagtatacctaagggattgatagcattgccagggtatatgtctgcatttgtataatcctacatgcttgtataaacatatggtccaatacatttcaaggcctgcctccgcaacacagccctggactactttctctgcgtggttgcagggtggacacatctgcttgtgctactgctcttcctgtggctctctcaactaaccccccttgtggcctatctggtgttctttttctgtgtctatctggggctgtggttgatatatgtgcaggccttttggtttttaccatagtcgttattatttcgccatacgttgctgctagcttgtatacatagtctatatacccattgtgtgagatttgcaatgtaccctgttgtgtataagggatctgagggaacatatcctgtggtactgtggggtcatgatgatgttcaatgtctgttggtgattcttatcctaatcgcctttttattgttgatgttttatgtccgtttgttaaaccacacctaacacccccacttttttatattgttttgatacattttcattttgatacatttgtgttttttttgtatttgctgcgttttaataaacgtgcaaccatgtctatacgtgccaagcgtcgaaagcgcgcctcccccacagacctctatcgtacctgcaagcaggcaggtacctgccccccagacattatcccaagagtggaacagaacactttagcagataaaatccttaagtggggcagtttaggtgtgttttttgggggtctaggtataggcaccggcagcggcacaggggggcgtactgggtacattcctgtaggttcgcgacccaccactgtagttgacattggtccaacgcccaggccgcctgttatcattgaacctgtgggggcctctgaaccctctattgtcactttggtggaggactctagcatcattaacgcaggagcgtcacatcccacctttactggtactggtggcttcgaagtgacaacctccaccgttacagaccccgccgtcttggatatcaccccctcaggtaccagtgtgcaggtcagcagcagtagctttcttaacccactatacactgagccagctattgtggaggctccccaaacaggggaagtatctggccatgtacttgttagtacagccacctcagggtctcatggctatgaggaaataccaatgcagacgtttgccacgtcggggggcagcggtacagagcctatcagtagcacacccctccctggcgtgcggagagttgccggaccccgcctgtacagtagagccaatcagcaagtgcaagtcagggatcctgcgtttcttgcaaggcctgctgatctagtaacatttgacaatcctgtgtatgacccagaggaaactataatatttcagcatccagacttgcatgagccaccggatcctgattttttggacatagtggcgttgcatcgtcccgccctcacgtccagaaggggtactgtccgttttagtaggttgggacgcagggctacactccgcacccgtagtggtaaacaaattggggcacgggtgcacttctatcatgatattagccctataggtactgaggagttggagatggagccactgttgcccccagcttctactgataacacagatatgttatatgatgtttatgctgattcggatgtccttcagccattgcttgatgagttacccgccgcccctcgcggttcactctctctggctgacactgctgtgtctgccacctccgcatctacactacgggggtccactactgtccctttatcaagtggtattgatgtgcctgtgtacaccggtcctgacattgaaccacccaatgttcctggcatgggacctctgattcctgtggctccatccttaccatcgtctgtgtacatatttgggggagattattatttgatgccaagttatgtcttgtggcctaaacgacgtaaacgtgtccactatttctttgcagatggctttgtggcggcctaatgaaagcaaggtatacctacctccaacacctgtttcaaaggtgatcagtacggatgtctatgtcacgcggactaatgtgtattaccatggtggcagttctaggcttctcactgtgggtcatccatattactctataaagaagagtaataataaggtggctgtgcccaaggtatctgggtaccaatatcgtgtatttcacgtgaagttgccagatccaaataagtttggcctgcccgatgctgatttgtatgatccagatacccagagacttctgtgggcgtgcgtgggagtagaggtgggccgtgggcagcctttgggtgtgggtgtgtctggtcacccatattacaatagactggatgacactgaaaatgcacacacacctgatacagctgatgatggcagggaaaacatttctatggattataaacagacacagctgttcattctgggctgcaaaccccctattggtgagcactggtctaagggtaccacctgtaatgggtcttctgctgctggtgactgcccgcccctccaatttactaacacaactattgaggacggggatatggttgaaacagggttcggtgccttggattttgccactctgcagtcaaataagtcagatgttcctttggatatttgtaccaatacctgtaaatatcctgattatctgaagatggctgcagagccttatggtgattctatgttcttctcgctgcgtagggaacaaatgttcactcgtcattttttcaatctgggtggtaagatgggtgacaccatcccggatgagttatacattaaaagtacctcagttccaactccaggcagtcatgtttatacttccactcctagtggctctatggtgtcctctgaacaacagttgtttaataagccttactggctacggagggcccaagggcacaacaatggtatgtgctggggcaatagggtctttctgactgtggtggacaccacacgtagcactaatgtatctctgtgtgccactgaggcgtctgatactaattataaggctaccaattttaaggaatatctcaggcatatggaggaatatgatttgcagttcatcttccaactgtgcaagataacccttactcctgaaattatggcctatatacataatatggatccccagttgttagaggattggaacttcggtgtaccccctccgccgtctgccagtttacaggatacctatagatatttgcagtcccaggctattacatgtcaaaaacctacacctcctaagacccctaccgatccctatgcctccctgaccttttgggatgtggatctcagtgaaagtttttccatggatctggaccaatttcccttgggtcgcaagtttttgctgcagcggggggctatgcctaccgtgtctcgcaagcgcgccgctgtttcggggaccacgccgcccactagtaaacgaaaacgggtaaggcgttagctctcagtgtcgcatcatttcctctgttctactttttacatattattttgttgtctgtaatatgtttatgttgttgttgtgcttatattacatgtatacatgtatggtatgtatcccctcccgtatgaataaacgtgtgtcatgtgttgtgtgttctgtaactgtacgttctggtgcacagatttctgcaccccatcgccttgtgtgtagcccccagtttcatgcaaccgttttcggttgcgtgcagtttcggtcggcgccgttgccaacccagcttaatcctttaattgctctcatcctaaagtgttatctgtgccagcgacgatgagtttggattttggttgtttaatgctttttcttttcagtttttcctttgtttgtgccaggccgcgagagggcgtgcacattcctaggctgattatcttaatgtgtttggcacatctttgtactgcgtctgcagaaaaacctgcagcaacagcactttgggcgcgtcgtttttgcagccaactttcacttgccaacttgccttgccgcgcattccaagaaacacacctattccggtcgcaatgtctactatgtgtggttt

SEQ ID NO: 20 - DNA, 7820 bp, Human papillomavirus type 3
tctaactataattataaataacaatgcacataataaaaagtagggagtaaccgaaaacggtacgaccgaatggggtacatataaaaggaggcacataatgcatggcagtagccatgtctatggatgcaaactgcccaaaaaacatatttctactgtgcagaaacaccggaataggatttgacgaccttcgcctgcactgcatattctgtacgaaacagctgactacaactgaactacaagcatttgcattacgggaactgaatgtggtgtggagaaggggagcgccctacggtgcttgtgcacggtgtttacttgtagagggcattgcacgacgcctaaaatattgggaatattcatattatgtatctggcgtggaagaagagacaaaacaatcaatagatacacagcaaattagatgctacatgtgtcacaaaccactggtaaaggaagagaaggacagacaccgcaacgaaaagcgaagactgcacaaaatatctggtcattggagggggagctgtcagtactgctggtcacgatgcacggtccgcatcccacgataaaagatatagaattgagtcttgcaccagaggacgtccctgcactatgcaatgtgcaattagatgaagatgagtatataaatgctgtggaaccagcgcaacaagcgtattgtgtagtcacagtgtgtccgaagtgtagttcacaacttcgactggtggtagagtgcagccacgcagatataagggccttcgagcagcttctgctgggcacactgacggttgtgtgtccccgctgcgtgtaacaggacatggatgatacttcaggtacagagggggaatgttccgagttggaacgggctggaggatggtttatggtagaggcaatagtagacaggcggacgggcgatacagtgtcaagcgatgaggatgaggaggaggacggaggggaagatttagtggatttcatagatgataggcctgtaggggacggacaggaagtggcacaggaactgttgctgcagcaagcagctgcggatgacgatgtagaagtgcagacagtaaaacgaaagtttgctcccagtccgtattttagccctgtgtgtgtacatcccagcatagaaaatgagctaagtccgaggctagatgcaataaagctggggagacaaacatcaaaagccaaacgccggctatttgagctaccggacagtgggtatggccaaacacaggtggatacggaatcgggaccaaaacaggtacaggacatttgtaagacaagccaacaagatggctgccagggtgcggatgaggggagaggtaggaatgtggggggaaatggcagccaggaggaggagcgtgcaggaggggatggggaggaatcgcagactgagagtgtacagacagatacgacagcctgtggagtgttggcaatattaaaagctagcaatcacaaagcaacgctactgggtaagtttaaagaacaatttgggttaggatttaatgaactgattagacactttaaaagtaacaaaacagtatgtagcgattgggtggtatgtgtgtttggtgtatactgtacattggcagaaagctttaagacgctaatacaaccacagtgcgaatatgcacatatacaggtactatcctgtcaatggggcatgacagtgttaacgttggtacggttcaaacgggccaaaaacagagagacggtggctaaaggtttcagcactttgctaaatgtgccagaaaaccacatgttaatagagccaccaaaattaagaagcgctccagcagcgctgtactggttcaaaacaagcctatcaaattgtagcgaggtgtttggggaaacaccagagtggatagttaggcagacagtggtgggacatgcattagaggaagcgcagttcagtctgtcagaaatggtgcagtacgcatatgaccacgacataacagatgaaagcacgttggcatatgaatatgcactacaagcagatacagatgcaaatgcagcagcgttcctagctagcaattgtcaggcaaaatatgtaaaggacgcatgcacaatgtgcagacattacaaaagaggtgaacaggcccgaatgaacatgtcagaatggataaagtttagaggagataaaatacagggggatggcgattggaaaccaatagtacagtatttaaggtaccaggacgtagaatttataccatttctatgcgctctgaaatcattcctacaaggaataccaaaaaaaagttgtatagtgttttatggaccagcagatactgggaagtcatacttttgcatgagcctgttgaaatttctgggcggggtagttatatcttatgccaattccagcagccatttttggttgcaaccattagcagaagccaagataggtttgctggacgatgcaactagtcagtgttggtgttatatagacacgtatttaagaaatgctttagatggaaaccaggtgtgcatagatagaaagcatagggccttgctacaactgaaatgtcctccgttattgataacaactaatataaatcctttgggggatgaaagatggaagtatctgcgcagcagactgcaggtgtttacatttaacaacaaatttccattaactacacaaggagagccactgtatacattaaatgatcaaaactggaaatccttttttcaaaggttatgggcacgtttaaaccttaccgatcctgaagacgaggaggacaatggaaacactagcgaaccgtttagatgtgtgccaggacaaaatactagaactgtatgaaaaggatagcgacaaacttgaggaccaaataatgcattggcaattgatgcggttagagcaagctttgttgtacaaagcaagggaatgtggattaacacacattggccaccaggtggtgccacctcttagtgtaaccaaagcaaaggcacgcagtgccattgaagtgcatgtatctttgcaacaattacagcacagtgcacatgcacaagacccctggacactgcgagacacgtcacgggaaatgtgggacacagttcccaagaagtgctggaaaaaaagaggtttaactgtggaagtcagatatgatggagacgaaaacaaagcaatgtgttatgtacaatggagggaaataattgtgcagaactatacagatgataactgggtgaaggtggcaggactggtgtctcatgagggtctatattacatgcacgaaggacagaaaactttttatgtaaaatttaaagatgatgcgcgcgtgtatggggacacaggaacatgggacgtacatgtgggaggcaaagtaattcaccacgattcatttgaccctgtatctagcacacgagagatacccgctcctggacctctgtacgcctgtaccacccaagcgcccacccaagcccaggtgggcgcgtccgaaggaccggagcaaaagcgacagcgactcgagacggtctacggggagcagcagcagcaacagcagcagcaacagcaacagcaacaacatacccaaacccccgccccgcaaaccactgaacgagcacgtcaaccattggacactgacaggacccgggaccgtgacactacgtgtccacaccccatcgggcatcgaagtgaccctgactgtgtgcctgtaatacacctaagaggtgatcctaactgtttaaaatgttttagatataggttaaacaaaggtaaaaataagttatattcaaggacctcttccacatggaggtggtcctgtgaatcagaaaatcagtgtgcgtacgtaaccatttggtatacaagttatggtcagcgggaagcatttttgtccaccgtaaaagtgccaccaggtattcaagtgatactgggacacatgtcaatgttcacataattgtgtccccgcattgtacagtctggattactatttgtgcaggctttctctgtgggtgtattttgtgctgctgctgtgtttgttttggctgtgtgtgcttcctgcgctaacgtgctatctggcaattgtgctttgtgtgtacttggtcctgatagcattgtatttacaaattgtatcacgcattgtacagaataacacataggttttactatgtatcctctggtactcacagacaacaatggcgaccatcttgtcttgtttgttgagcctggagacgtgtacatattattgctgtttatgttagctgtcatacttacattgtttattatgtatagacatctgggactcctgtaaggttgtagttgcaggtcacctgtatgtattcttccttgatgtatatgccctagtgtggtattgtaccaccgtcttttatactgctatgtttttttttacagttcaataaagcaaccatggtggcacatcgtgcaaggcgtcgcaagcgtgcatctgccacacagctttatagaacctgcaaggccgcaggcacatgtccccctgatgttattcccaaagttgagggcaccactttggccgatcgtattttgcaatggggtagcttgggtgtttatttggggggtctgggcattggtactggatccggaactggggggcgcacagggtatgcgccaattagtacacggcctggtactgttgttgatgttagtgttcctgcaaaacctcctgtggtaattgagcctgtggggccatcggacccctccattgttaacctattggaagactccagtattattaattccgggtccaccataccgacctttactggtactgatggattcgaagttatttcttcagccacaactacccctgctgtattagatattacacctgccagtgacaatgtggtggttagtagtaccaattttagcaatccagcttttacagaaccttccctgttggaggttcctcagaatggtgaggtttcagggcacatacttattagcacccccacatctggtacacatggttatgaagaaattcctatggaaacctttgcttcgccaggtacgggaactgaacctattagtagcacccctgtacctggtgtaagtagaattgcaggtccccgcctatatagcaaagctgtcacacaggttaaggtaacagatcctgctttcttgacccgtcctcgctcgttaatgacatttgacaatcctgtgtttgagccagaagatgagactataatatttgaacgtccgtactctccctcacaggtgcctgactctgacttccttgacattttacgtttgcacaggcctgctttaacttctcgtaggggtactgtgcgttacagtagggtaggccaaaaattaagcatgcgcactcgcagtggcaagggtcttggtgctcgagtgcattattatcaagatttaagccccataggtcctacggaggacattgaaatggaacccttgattgctcctgcatctgcctcagcctatgactctctgtatgatgtgtatgcagatgtggacgatgctgacataggttttacatctggaggtcgtagtgacactctgtctagaggccgtgctacagtgtcccccctgtcctccactctgtccacaaagtatggcaatgtcaccattccctttgtgtctcctgtggatgtgcctttacaacctgggcctgatattttactgcctgcatcagctcagtggccgtttgttcccttgtctcctgttgacacaactcattatgtctacatagatggcggggatttttatctatggcctgtcaccttctttttgccccgacgtcgtcgccgtaaacgtgtctcatattttcttgcagatggcactgtggcgctctagtgacaacctggtgtacctgcctcctacccctgtttccaaggttctcagcacggacgactatgtgacacgcaccaacatttattattatgcaggcagttctcgcttgctgaccgtgggtcatccttattttgctatccccaaatcttctaattccaagatggatattcctaaggtgtccgcctttcaatatagagtgtttagggtgcggttgcccgacccaaataagtttggcctaccagatgcacgcatatataacccagacgccgaaaggctggtctgggcttgcactggggttgaggtaggccgcgggctgcctttgggtgtaggcctcagtggacatcctctttataacaagctagatgacactgaaaactctaacatagcacatggggacataggtaaagattcccgggacaacatatctgttgacaataagcaaacgcagctatgtattgtgggttgtaccccacctatgggggagcattggggcaaaggaacaccatgtaagcagaatgcgtcaccgggtgattgtcctcctctagagcttattactgcacctatacaagatggcgatatggtggacacaggttatggtgccatggactttggtaacttgcagtccaataagtcagacgtgccattagatatttgccagaccacctgcaaatatcctgattatttgggtatggccgctgagccctatggcgacagcatgtttttttatttgcgaaaggagcagttgtttgcaagacattttcttaacagagctggtatggctggagacaccgtgcctgacgcgttgtacattaaaggtgacagtcagagcggcggtcgggataaaattggtagtgctgtgtactgtcctacccctagtgggtccatggtaacatctgaaacgcagctattcaataagccatattggctgcggcgtgctcagggacacaataatggtatatgttgggccaaccaattgtttgtgactgtggtggataccacacgtagtactaatatgacattgtgtgtttctactgaaacctcggctacatatgatgctactaaatttaaagagtatttaagacacggggaggaatatgatttacagtttatattccagttgtgcaaagttacattaactcctgaaattatggcctatttacacacaatgaacagtactttgttggaggattggaactttgggttaaccttgccaccgtccactagcttggaggacacctatagatttttaacttcctctgccattacctgccagaaagatgcacctcccactgagaagcaagacccctacgccaaactaaacttttgggatgtagatcttaaggatcgtttttccctggatctttcgcagttcccccttggcaggaaatttctcatgcagctcggtgtaggtacccgctctagtatatctgttcgtaaacgctcggcgacaaccacatctagaacagctgctgcaaaaaggaagcgcaccaaaaaatagccacatttgtgttttgtatgtgtaacctgtgtgtatgttttttatgtatgtactgtgtgtgtaatgtgtactgtctgtgctatgtgtttgtacgttattatgttgtgtgtatgtgtcaataaactgtgtcacatagttttatattttttaatttttgtaattactgttcctgtgagtaagaaaggtaattctgggtcatgcgaccgatttcggttctcaaaatggccgcctttgcaggtgtgcacacaaacaattagtcatactgatctatatcctgcgacctgccttgtcacgcatagttttggctgtgatattatcttttctatagtttattttattgctgcatcattctccctggcacgtctatctgtctccattgcaaattaacagcttctgggcactaacttattatgactactttcacataattactgtcttggctgcgttttctagtctgccttgccaatatgtgcttccaaatctccaccaagacacacctaatccggtcgctgcttgctttctagccataatttatgcagttgctacacgttcctt

SEQ ID NO: 21 - DNA, 7353 bp, Human papillomavirus type 4
gtctgtaatgatagttggcaacaatcattacttatagctatatataaccggaagagatacatataaaaagggacagtgcatttctactaaatcctgtccagatggcagatggcagacctgcaaccttggacgacttctgcagacgattcgacatttccttttttgatttgcgccttacttgtattttttgttctcatactgtcgatcttgcggatcttgctttattctatcttaagaaacttagtttagtatttagaggaaattgttattatgcatgttgttctgaatgcttaagattaagtgcactgtttgaacaagagaattattttcaatgttctattaaagctgtacatttggaggaaattgctcagaaaaagattaaggaaatttgcattagatgcatttgctgccttagattacttgatattgttgagaaattagatttattatactctgacgagacttgctatttaataaggggtttgtggaggggctattgcagaaattgtattaggaaacaatgagaggagcagcgcccacggttgcagatcttaatttagaactaaatgacttagtgttaccagcaaacctgctgagtgaggaggtcttgcaatcttcagatgatgagtatgagattacagaggaggagtcggtggttccatttagaatagacacctgttgctatagatgtgaagttgctgtaagaattacattgtatgctgctgagctcggactacggaccttggaacaacttcttgtagaaggaaagctgacgttttgctgcaccgcttgtgcaagaagtcttaacagaaatggcagataaaggtacagacaattttgacttagaagggaataattggtatattgtccatgaagcagaatgcactgacagtatagatacgttggatgatttatgcgacgaaagtaatgacgattcaaacatttctaacttaattgatgacgatgtcgttgatcaggggaattcccttgcgctgtacaatgcacaaataaatgaggattgtgacaatgcactagcacacctaaaacgaaagtataacaaaagtccagagcaggcagtcgctgaattgagtccgcagttgcaggctgtgaaaataactcctgaaagacacagcaaaaggagattatttcaggacagtgggattttcgaagatgaagctgaaaattctcttacacaggtagaatccgagagccaggctggaccttctagccaagatggcggcggagatattaatttgttgttgttacaaagtagtaacaggagggcaacaatgctagcaaagtttaaagaatggtatggggtctcatacaatgaaataacaagaatttataaaagtgataaatcttgtagtgataattgggtaatagttatttttagagctgctgttgaagtattagaaagttcaaagattgttttaaagcagcattgtacatatattcaagttaagatctttggattttcagctttatatttagtacagtttaaaagtgcgaaaagtagagaaactgtacaaaagttgatgtgttctatattaaatatccaagaatatcaaatgttatgtgatcctccaaaattacgaagtgtacccacagcattatacttttataagcatgctatgttaacagagagttctgtttttggacaaacaccggattggatcgcaaaacaaactctcgtaagtcatcaagcagcaactactgcagagacttttgagttatctagaatggttcagtgggcatacgataataattatgtggatgaatgtgacattgcttatcactatgcaatgtacgcagaggaggatgcaaatgctgctgcttatttaaaaagtaataatcaagtaaagcatgtacgagattgtagtacaatggtcaggatgtataaaagatatgaaatgagagatatgtcaatgtcagaatggatttataaatgttgtgatgaatgttctgaagaaggagattggaagccaatctcacagtttttaaaatatcaaggtgttaatatattatcctttcttatagtgcttaaatcatttttaaaaggtattccaaaaaaaaactgtatagttattcatggtccaccagatacaggaaaatcattattttgttattcttttataaaatttttaaaaggaaaagtagtttcatatgtaaatagaagtagccatttttggttgcagcctctgatggattgcaaggtaggatttatggatgatgctacctatgtgtgctggacatatatagatcaaaatttaaggaatgcattagatggtaatccaatgtgtattgacgctaaacacagagcaccacaacaattaaaattaccaccaatgctaataacgtcaaatattgatattaaacaggaacaatctttaatgtatttacacagtagaatacagtgttttaattttcctaacaaaatgcctattttagatgatggtagtcctatgtatacatttactgacggtacttggaaatcttttttccaaaagcttggcagacaattagaattaacagatcctgaagaggaaaacaatggagtccctagtcgcacgtttcgatgcacttcaagaagcaattctgactcatattgagtcacaggagagcactttggaatcccaaatccaatattgggaaaatatcagaaaagaaaatgctataatgcattatgctcgaaaacaaggcctaaccaaattaggtctacaaccacttcctacactagcagtaactgaatacaatgcaaagcaagctattcagatacatttaactttgcaatcattgttaaaatctccctttgcatctgaacggtggacattgacagatgttagtgcagaactgataaatacctctccacaaaactgtttaaaaaagggaggttatgatgttgctgtgtggtttgataatgatagacagaatgcaatgctgtacacaaattgggactttttatattatcaagatatgaatgaacagtggcacaaagttaaaggtgaagtggattatgatggcttatactttacagaccatacgggagaaagagcttattttacattatttagctctgatgctcaaagatttagcagaactggactgtggactgtgcattttaaaacccaagttatttcctcccctattgttagctctacatactcctcctccttcgacactgaggaacaacagttacccgggccctccaccagctactccgaagttaccgagcaggcgagccctactcgaaggaggaaaccgaggaaatccgacgcgacctccaccacgtcccctgaaaccgagggagtacgactacgacgaagacgacgagaaggaaaatcagggcccgggtcaggagaaaccccccgcaaaagaagaagaggaggaggaagaggaggaggagagaccgaattgggatctgcaccatctcctgcagaagtggggagcagacatcgacaagttgaaagacaaggtctgtcgcgacttggactcttacaagcagaagctagggatccgcctatgatattgttaaagggcacagcaaattctttgaaatgttggagatatagaaaagttaactcaaattgctgcaacttcttattcatgagtactgtttggaactgggttggagattgctcacataatcatagtcgcatgcttattgcatttgatagcactgaccaaagagacgcttttgtaaaacacaacctttttcctaaactgtgtacatatacctacggctcattgaatagtttataaaatgcaaagcttgagtagaaggaaaagagattcagttccaaatctttatgcaaaatgtcaactgtctggcaattgcctacctgatgtaaaaaataaagtagaagctgatactcttgctgatcgtttgctgagatggttgggaagtgtaatatacctaggaggcttgggtattggtactgggagaggtagtggggggtcaactgggtataatccaattggagctccaagtagagtcacacctagtggtactttagtaaggcctacagtgcctgtggaaagtttgggaccctcagaaataatcccaatagatgcaatagacccaacaacatcttctgttgtgccattagaggatctgaccatcccagatgtcacagtagatagtggagatacaagaggaataggggagactactcttcagcctgcacaagtagatatttcaacatcacatgaccctatatcagatgtcactggtgctagcagccaccctacaatcatatctggcgaggataacgccattgcagtgttagatgtgtcccctatagaacctcccacaaaacggatagcattggcaactaggggagcctcagcaactccacatgtaagtgtcatatctggcacaaccgaattcggtcagtcatctgatctgaatgtatttgtgaatgccacattttcaggcgattccattggttatacagaagaaattccattagaaccgttgaacccctttcaagaattcgaaatagaaagccctccaaaaactagtacaccacgtgacgttttaaatcgtgcaataggaagagcacgggatttatataatagaagggttcagcaaatacctactaggaacccagctttactgacacagccttcccgcgcaatagtatttggatttgaaaatcccgcctttgatgctgacatcactcaaacatttgagcgggatttagaacaggttgcagcagctccagatgctgactttgcagacatagtcactatagggcgtccaaggttttcagagacagatgctggtcaaattagagttagcaggcttggacgccgaggcacaataaaaactagaagtggtgtgcaaattgggcaggcggttcatttttattacgacctaagtacaatagatactgctgatgctattgaattatctactttaggtcaacattcaggagaacaaagcattgttgatgctatgatagaaagcagcttaatagatccttttgaaatgcccgatcctacttttacagaagaacaacagcttttagatccacttacagaagattttagtcagtcacacttggtgcttactagtagcagacgtgggacatcatttactatacctacaataccacctggattaggtcttagaatttatgtagatgatgtaggttctgatttatttgtttcctatccagaatctagagtaatacctgctggaggtttaccaactgagccatttgttcctctagaaccagctttgttatctgatatatttagtacggattttgtatatcgtcctagtttatatcgcaagaaacggaaacgattagaaatgttttaattgttttgcaggaacatgtcgagttggttatctacaacgggtaaagtctacttacctccagctcaacctgtggcaagagttttggaaactgacgaatatatcactggaacatctctgtatttccacgctggtacagaaaggcttttaactgtaggccatccttattttccagtgaaagatgtacaggaacctcacaaagtattagttcctaaggtttcaggaagtcaatttagagtgtttagattcaatttgccagacccaaacagatttgctttaattgataatggcttttatgattctgatcatgaacgcctagtatggaaactgaggggaatagaaataggaagaggaggaccgcttggtataggtactacaggtcatcctttatataataagtttggagacacagaaaatcctaatggctacaaaaagcaatcagatgataatagacaggatgtctctttagacccaaaacaaacacagatgtttattataggttgcactcctgcaataggtgaacattgggataaagctgaaccttgtcccagccctgctccgcaacagggagattgcccaccaatagagcttgtaaattcatacattcaagatggagatatgtgtgacattggatttggggctttcaattttaaagctttgcaggctgataaatctagtgctcctttggatgtcattgccacagtttgtaaatggccagattttttaaaaatggggaaagatatctatggagatagcttgtttttctttggaagaagagaacaactatatgccagacatttctttgtcagagcaggcaccatgggagatgctctaccagaaccttttgaagctacctcagattattttattggtgctcaaaaccaacaagatcagtacactttaggacctcatatttatgtagggacccctagtggctctttagtatccagtgaatcccagttgtttaatcgaccgtattggttaaacagagctcagggtacaaataatggaatttgttgggataatcagttgtttgttactcttgtagataacactcataatacaaactttacaatttctgtgaagtcagatggtgctaatgacaattatcagtataaagctagtgattttaaacagtacctcagacatatagaggagtttgaaatggaatttatatttcaactttgtaaagttcctctaactgcagatgttatggctcatttaaatgtaatgaatcctaatattttggataattggcagttaaattttgttccaccacctccctctggaattgaggatcaatatagatttttgcaatctagagctacaagatgccctacacagacccctgcaactgaaaaagaagatccatataaagatttgtctttttgggttgttgatttaagtgaaagattttccagtgaattgagccaattttccttaggcaggcggtttttatatcaaagtggtttaattaatggttctctaaaacgtaaaagaataataagttcttctcatgcacaaactaataccaaacgttctgccaaacgaaaacggtctctgaaataacaatgtgaactcttctggaatgttttattctgccaggaaaaccttcaactgagccaaattattatataatcgttcttaatctcaaaattgagctaattatataagatttgcaaacgtgtatgtatctgtttttgtgaactatagtgaaataaactgccacatacttgccagtgtccagtctctctgagtcatttggtcaacatgcgtccgcaccccaataattatttgcatacacagatcagtaggagaggcgccaagacggacatatcctcttcaaatttccttaaaattattgaatttaacaactgtaagctacaaaagaccgttatcgtttcctctaaccttgggaaaaaggtgagtgaaagttttattgcaccttttgtgagtcaatttgtctggcggcgctgaacgaatttggctgtcagcctttgcaccgggagtggtggaaaatagtttct

SEQ ID NO: 22 - DNA, 7746 bp, Human papillomavirus type 5
aacggtaagttgcaatttccttgtaccaggtgcggtattgggatttcacaattataatggttgttgccaactaccataggcatattcaagtttttgcctgtatcgttttcgtatcctgtaataatatccaatatatgtatacataaataaatatatatatatataagtgtctaagattgggttcttctgtaatcaggcaatggctgagggagccgaacaccaacagaaactgacagaaaaagataaggcagaattacctttaagtattagagacttagctgaagccttaggcatccctgtgattgattgtttaataccttgcaatttctgtggcaactttctaaattatttggaagcttgtgaattcgactacaaaaggcttagtctaatttggaaagattattgtgtgtttgcgtgctgtcgcgtatgctgtggcgccactgcaacttatgaatttaaccaattttatgagcagacagtgttaggaagagatattgaattagcttcaggactttcaatatttgatattgatatcaggtgtcaaacttgcttagcatttcttgacattatagaaaagttagattgctgtggcagaggccttccctttcataaggtgaggaacgcctggaagggaatctgtaggcagtgtaagcatttttatcatgattggtaaagaggtcaccgtgcaagatattattctggagctcagtgaggtgcagcccgaagtgctaccagttgacctgttttgtgaagaggaattaccaaacgagcaggaaacggaggaggagcctgacaacgaaaggatctcttacaaagttatagctccgtgcggttgcaggaactgtgaggtcaagcttcgcatttttgtccacgccacagaatttggtattagagctttccaacagctactgaccggagatctgcagctcctgtgccctgactgtcgcggaaactgcaaacatgacggatcctaattctaaaggtagtacatctaaagaagggtttggtgattggtgtttattggaagctgactgtagtgatgtagaaaatgatttgggacaattatttgagagagatacagactctgatatatcggatttgttagatgatactgaactggagcagggcaattccctggaactatttcatcaacaggagtgtgagcagagcgaggagcaattgcaaaaactaaaacgaaagtatcttagtccaaaagctgtcgcacagcttagtccgcgacttgagtcaatttcattgtcaccccagcagaagtctaagcgaaggctctttgcagagcaggacagcggactcgagctgactttaaacaatgaagctgaagatgttactcctgaggtggaggtaccggctattgactctcggccggatgacgagggaggttcaggggacgtagatatacattacactgcattgttgcgttctagcaacaaaaaagctacattaatggctaagtttaaagagtcgtttggagtaggttttaatgaattgacacggcaattcaaaagccacaaaacctgctgtaaggactgggttgtctctgtatatgcagtgcatgatgatctatttgaaagctcaaagcagctattgcaacagcattgtgactatatctgggtccgtgggataggtgcaatgtcattatacctattgtgttttaaggcgggaaaaaatcgcgggacagttcataagttaattacctcaatgttaaatgtgcatgaacagcaaatattgtctgagccgccaaaattgagaaatacagccgctgcattgttctggtataagggttgtatgggatcgggggcgtttagccatggaccatatcctgattggattgcccaacaaactatattaggtcacaaaagtgctgaggcaagtacttttgatttttcagcaatggtccaatgggcatttcataatcacttattagacgaagcagatatagcataccagtatgcaaggcttgctcccgaagacgcgaatgcagtagcttggcttgcacataacaaccaggccaaatttgtgagagaatgtgcatatatggtacgattttataagaagggacaaatgagagacatgagtatatctgaatggatatacactaaaatcaatgaagtagaaggggaagggcactggtcagatatagtaaagtttattagataccaaaatataaactttattgtattcctaactgcattaaaagaattcctacactcagtgccaaaaaaaaattgcattttaatttatggtcctccaaattctggaaagtcatcatttgcaatgtcattaataagagtgttgaagggtagagtgttgtcatttgtaaattctaaaagtcagttttggctgcaacccctttcagagtgcaagatagctctattggatgatgtaacagacccttgttggatatacatggatacatatttaagaaatggcttggatggacattatgtttcattagattgtaaatatagagccccaacgcaaatgaaatttcccccattattattaacatctaacattaatgtgcatggggaaactaattatagatatttacacactacaataaaaggatttgaatttccaaatccttttcctatgaaagcagataatacacctcagttcgaactaactgaccaaagctggaaatctttttttacaaggctttggacacaattagacctgagtgatcaagaagaggagggcgaggatggagaatctcagcgagcgtttcaatgctctgcaagatcagctaatgaacatttatgaagctgcagaacaaacattgcaggcacaaattaaacattggcaaaccttacgaaaagaacctgtattactctactatgctagggagaaaggtgttacaaggcttggatatcaacctgtgcctgtaaaggcagtatcagaaacaaaggctaaagaagccatagcaatggtgctgcagcttgagtcactacagacatctgattttgctcatgagccatggactctagttgataccagcatagaaacatttagaagcgctccagaaggtcacttcaaaaaaggccccctccctgtagaagttatttatgacaatgatccagataatgccaatttgtatacaatgtggacctatgtgtattatatggatgcggatgataagtggcataaggcaagaagtggggtgaatcacattggcatttattatttacaaggaacttttaaaaactattatgtactgtttgctgacgatgcgaaaagatatggtacaactggagaatgggaagtaaaagttaataaggaaactgtgtttgctcctgtcaccagctccacgcctccagggtcgccaggaggacaagcagacacaaacaccacccccgcgacccccaccacctccacaaccgccgttgactccacgtccagacagctcaccacatcaaaacagccacaacaaaccgaaaccagaggaagaaggtacggacggaggccctccagcaagtcaaggagatcgcaaacgcagcaaaggcgatcaaggtcccgacaccggtcccggtctcggtcccggtcgcggtccaagtcccaaacccacaccactcggtccaccaccaggtcccggtccacgtcgctcaccaagactcgggcccttacaagcagatcgcgatccagaggaaggtccccaaccacctgcagaaggggaggtggaaggtcacccaggcggcgatcaaggtcaccctccacctcctcctcctgcaccacacaacggtcacagcgggcacgagccgaaagttcaacaaccagaggggcccgagggtcgagagggtcacgaggagggagccgtggggggagagggcggcgacgaggaaggtcatcctcctcctcctcccccgcccacaaacggtcacgaggggggtctgctaagctccgtggcgtctctcctggtgaagtgggagggtcacttcgatcagttagttcaaagcatacaggacgacttggaagattactggaagaagctcgcgaccccccagtaatcattgtcaaaggggcggctaacacactgaaaaatgtccgcaacagagctaaaattaaatacatgggactgtttaggtcatttagtactacctggtcatgggtggcaggagatggcactgagcgtctaggcaggcccagaatgctcattagcttttcttcctatactcaaaggagagattttgatgaagcggtgcgataccccaaaggagttgataaggcctatggcaacctggacagtctttaacatttactaatgctgcttttgctactaacatactaacataccctagcattttatatttttttttacattttgtatttgctatggcgcgtgcaaaaacggtcaagcgagactctgtaactcatatttaccaaacctgcaaacaggcaggcacttgcccccctgatgttattaataaagtggaacaaacaacagttgctgacaatattttaaaatatggcagtgctggtgtattttttggtggccttggtattagtacaggccgaggaactgggggtgctacagggtacgtgccacttggggaaggtcctggtgtccgtgtcggaggaacccccacggttgtaaggccttccttggttcctgaaacaatcgggcccgttgatattttgcccattgatacagttaaccccgtggaacctacagcatcatccgtggtccctctaactgagtccacaggcgctgatttacttccaggtgaagtagaaacaattgctgaaatccatcctgtacctgaggggccatcagtggatacccctgtagttaccactagcacaggttccagtgctgttttagaggttgccccagagcctattcctccaacacgggtcagggtttcacgcacacagtatcacaatccatcttttcaaataataactgagtctactccagcacaaggggaatcgtctcttgcagatcacgttttggtgacatcgggttctggggggcaacgaatagggggtgatataactgacataattgagttagaggaaattcctagtaggtatacatttgaaattgaagaaccaactcctccacgccgcagcagtactccattgccacgcaatcaatctgtaggccgtaggaggggtttctctttgactaatagacgtttagtacagcaggtacaagtggacaatccattgtttctaactcaaccatctaagttagttcgttttgcatttgataatcctgtttttgaggaagaagtgactaatatatttgaaaatgatctggatgtctttgaagaacctccagacagagattttcttgatgttagggaattgggacgtccacaatattctacaacaccagcgggatatgttagagtaagcaggttggggactcgagccactattcgcactcgctctggtgcacagatagggtcgcaagtccatttttacagagatcttagctctattaatactgaagatcctattgaattacaattattaggccaacattcaggtgatgctactatagtccacggacctgttgaaagcacatttatagatatggatatttctgaaaatccattatctgaaagcattgaagcatattcacatgatttattattagatgaaacggtggaagatttcagtgggtctcagctggttataggtaatcgaaggagcacaaactcttacactgttcctaggtttgaaactacaagaaatggttcatactatacacaagacacaaagggatattatgttgcatatccagagtcacgtaataatgcagaaatcatttatcctacacctgatattcctgtagtcattatacaccctcatgacagtacaggggacttttatttacatcccagtcttcacaggcgcaaacgtaaaagaaaatatttgtgatttgcattcgagatggcagtgtggcactcggctaatggtaaagtatatcttccaccatcgacaccggtggccagagtccaaagcaccgatgaatacattcaaagaacaaatatctactatcatgcatttagtgacagattgttaactgtaggtcatccttatttcaatgtatacaatattaatggtgataagcttgaggttcctaaggtttcaggaaatcaacacagagtatttcgcctaaaattaccagatcctaacagatttgcattacctgatatgtctgtttacaaccctgacaaagaacgtttggtttgggcctgtagaggcttagaaataggtaggggccagccattaggtgtacggagtactggtcacccttatttcaataaagtaaaagatacagaaaacagtaatgcatacataacattttctaaagatgacagacaggatacatcttttgatcctaaacagatccaaatgtttattgtaggatgcacaccttgcataggagagcattgggataaagctgttccatgtgcagaaaatgatcagcaaactggcctttgtcctcctattgaactaaaaaacacatatatacaagatggtgatatggcagacataggttttgggaacatgaattttaaggcacttcaagatagtagatcagatgtcagtttagacatcgtcaatgaaacttgcaagtatccagattttttaaagatgcaaaacgatatttatggcgatgcgtgctttttttatgctcgtagggagcaatgttatgccagacacttttttgttagagggggaaaaactggtgatgacattccacgtgcacaaattgacaatggtacatacaaaaatcagttttacattccaggggctgatggccaagctcaaaagactataggaaattccatgtatttcccaactgttagtggctcattagtatccagtgatgctcaattgtttaacaggcccttctggctccaaagagcccaaggtcataataatggcatcctgtgggctaatcaaatgtttatcacagtggttgacaacacaagaaatactaatttcagtatttctgtatataatcaggctggagcactaaaagatgttgcagactataatgcagatcaatttagagaatatcaaagacatgtagaagaatatgaaatatctttaattctacaactctgtaaggttcctttaaaggcacaggtattggcacagatcaatgcaatgaactcttcgttattggaggattggcagttaggatttgttcccactcctgataatccaattcaggacacctacagatatattgactctttggctacacggtgtccagataagaatcctccgaaagaaaaggaagacccttataagggcttacatttttgggatgtagatttaactgaaagattgtcattagatttagatcaatattccttaggcagaaaatttttattccaagctgggttacaacaaacgaccgttaacggtacaaaagcagtgtcttataaagggtctaatagaggaacaaaacgcaaacgtaaaaattgaggtctgaccgaaagtggtacatttttataaacttttacacagtattcaaggaatgtttgtttactctgactaagtataagtcttccaaggataccgaccgcacccggtacactcagtcaagttgttgccaatatagaatcagatcagtgccaaacacaccgtcttggactcagaacagaccgtgttcgttataacatgctcggattagggacctccccaaagaagatttaatctacaatcgcttttggcaatcgcatttggcactgctaaaagaccgtt

SEQ ID NO: 23 - DNA, 8012 bp, Human papillomavirus type 6
gttaataacaatcttggttttaaaaaataggagggaccgaaaacggttcaaccgaaaacggttgtatataaaccagccctaaaatttagcaaacgaggcattatggaaagtgcaaatgcctccacgtctgcaacgaccatagaccagttgtgcaagacgtttaatctatctatgcatacgttgcaaattaattgtgtgttttgcaagaatgcactgaccactgcagagatttattcatatgcatataaacagctaaaggtcctgtttcgaggcggctatccatatgcagcctgcgcgtgctgcctagaatttcatggaaaaattaaccaatatagacactttgattatgctggatatgcaacaactgttgaagaagaaactaaacaagacattttagacgtgctaattcggtgctacctgtgtcacaaaccgctgtgtgaagtagaaaaggtaaaacatatactaaccaaggcacggttcataaagctaaattgtacgtggaagggtcgctgcctacactgctggacaacatgcatggaagacatgttaccctaaaggatattgtattagacctgcaacctccagaccctgtagggttacattgctatgagcaattagtagacagctcagaagatgaggtggacgaagtggacggacaagattcacaacctttaaaacaacattaccaaatagtgacctgttgctgtggatgtgacagcaacgttcgactggttgtgcagtgtacagaaacagacatcagagaagtgcaacagcttctgttgggaacactaaacatagtgtgtcccatctgcgcaccgaagacataacaacgatggcggacgattcaggtacagaaaatgaggggtctgggtgtacaggatggtttatggtagaagctatagtgcaacacccaacaggtacacaaatatcagacgatgaggatgaggaggtggaggacagtgggtatgacatggtggactttattgatgacagcaatattacacacaattccttggaagcacaggcattgtttaacaggcaggaggcggacacccattatgcgactgtgcaggacctaaaacgaaagtatttaggtagtccatatgttagtcctataaacactatagccgaggcagtggaaagtgaaataagtccacgattggacgccattaaacttacaagacagccaaaaaaggtaaagcgacggctgtttcaaaccagggaactaacggacagtggatatggctattctgaagtggaagctggaacgggaacgcaggtagagaaacatggcgtaccggaaaatgggggagatggtcaggaaaaggacacaggaagggacatagagggggaggaacatacagaggcggaagcgcccacaaacagtgtacgggagcatgcaggcacagcaggaatattggaattgctaaaatgtaaagatttacgggcagcattacttggtaagtttaaagaatgctttgggctgtcttttatagatttaattaggccatttaaaagtgataaaacaacatgtgcagattgggtggtagcaggatttggtatacatcatagcatatcagaggcatttcaaaaattaattgagccattaagtttatatgcacatatacaatggctaacaaatgcatggggaatggtattgttagtattattaagatttaaagtaaataaaagtagaagtaccgttgcacgtacacttgcaacgctattaaatatacctgaaaatcaaatgttaatagagccaccaaaaatacaaagtggtgttgcagccctgtattggtttcgtacaggtatatcaaatgccagtacagttataggggaagcaccagaatggataacacgccaaactgttattgaacatgggttggcagacagtcagtttaaattaacagaaatggtgcagtgggcatatgataatgacatatgcgaggagagtgaaattgcatttgaatatgcacaaaggggagattttgattctaatgcacgagcatttttaaatagcaatatgcaggcaaaatatgtgaaagattgtgcaactatgtgtagacattataaacatgcagaaatgaggaagatgtctataaaacaatggataaaacataggggttctaaaatagaaggcacaggaaattggaaaccaattgtacaatttctacgacatcaaaatatagaatttattccatttttaagtaaatttaaattatggctgcacggtacgccaaaaaaaaactgcatagccatagtaggccctccagatactgggaaatcgtacttttgtatgagtttaataagctttttaggaggtacagttattagtcatgtaaattccagcagccatttttggctgcaaccgttagtagatgctaaggtagcattgctagatgatgcaacacagccatgttggatatatatggatacatatatgagaaatttgttagatggtaatcctatgagtattgacagaaagcataaagcattgacattaattaaatgtccacctctgctagtaacatccaacatagatattaccaaagaagagaaatataagtatttacatactagagtaacaacatttacatttccaaatccattcccttttgacagaaatgggaatgcagtgtatgaactgtcaaatgcaaactggaaatgtttttttgaaagactgtcgtcaagcctagacattcaggattcagaggacgaggaagatggaagcaatagccaagcgtttagatgcgtgccaggaacagttgttagaactttatgaagaaaacagtactgacctaaacaaacatgtactgcattggaaatgcataagacatgaaagtgtattattatataaagcaaaacaaatgggcctaagccacataggaatgcaagtagtgccaccattaaaggtgtccgaagcaaaaggacataatgccattgaaatgcaaatgcatttagaatcattattaaagactgagtatagtatggaaccgtggacattacaagaaacaagttatgaaatgtggcaaacaccacctaaacgctgttttaaaaaacggggcaaaactgtagaagttaaatttgatggctgtgcaaacaatacaatggattatgtggtatggacagatgtgtatgtgcaggacactgactcctgggtaaaggtgcatagtatggtagatgctaagggtatatattacacatgtggacaatttaaaacatattatgtaaactttgtaaaagaggcagaaaagtatgggagcaccaaacaatgggaagtatgttatggcagcacagttatatgttctcctgcatctgtatctagcactacacaagaagtatccattcctgaatctactacatacacccccgcacagacctccacccctgtgtcctcaagcacccaggaagacgcagtgcaaacgccgcctagaaaacgagcacgaggagtccaacagtcaccttgcaacgccttgtgtgtggcccacattggacccgtggacagtggaaaccacaacgtcatcactaacaatcacgaccagcaccaaagaaggaacaacagtaacagttcagctacgcctatagtgcaatttcaaggtgaatctaattgtttaaagtgttttagatataggctaaatgacaaacacagacatttatttgatttaatatcatcaacgtggcactgggcctcctcaaaggcaccacataaacatgccattgtaactgtaacatatcatagtgaggaacaaaggcaacagtttttaaatgttgtaaaaataccccctactattagacacaaactggggtttatgtcaatgcacctattgtaatttgtatatatgtaaatgtgtaaatatatggtattggtgtaatacaactgtacatgtatggaagtggtacctgtacaaatagctgcaggaacaaccagcacattaatactgcctgttataattgcatttgttgtatgttttgttagcatcatacttattgtatggatatctgactttattgtgtacacatctgtgctagtactaacactgcttttatacttactattgtggctgctattaacaacccccttgcaatttttcctactaactttacttgtgtgttactgtcccgcttgttatatacaccactacattgtgaacacacagcaatgatgctaacatgtcaatttaatgatggagatacctggctgggtttgtggttgttatgtgcctttattgtaggggtgttggggttattattaatgcactatagagctgtacaaggcgataaacacaccaaatgtaacaagtgtaacaaacacaactgtaatgatgattatgtaactatgcattatgatactgctggtgattatatatatatgaattagagtaaaactttttttatatttgtaacagtgtatgctttgtataccatggcacatagtagggcccgacgacgcaagcgtgcgtcagctacacagctatatcaaacatgtaaactcactggaacatgccccccagatgtaattcctaaggtggaacacaacaccattgcagatcaaatattaaaatgggggagtttgggggtgttttttggagggttgggtataggcaccggttccggcactgggggtcgtactggctatgttcccttaggaacttctgcaaaaccttctattactagtgggcctatggctcgtcctcctgtggtggtggagcctgtggccccttcggatccatccattgtgtctttaattgaagaatcggcaatcattaacgcaggggcgcctgaaattgtgccccctgcacacggtgggtttacaattacatcctctgaaacaactacccctgcaatattggatgtatcagttactagtcatactactactagtatatttagaaatcctgtctttacagaaccttctgtaacacaaccccaaccacccgtggaggctaatggacatatattaatttctgcacccactataacgtcacaccctatagaggaaattcctttagatacttttgtgatatcctctagtgatagcggtcctacatccagtacccctgttcctggtactgcacctcggcctcgtgtgggcctatatagtcgtgcattgcaccaggtgcaggttacagaccctgcatttctttccactcctcaacgcttaattacatatgataaccctgtatatgaaggggaggatgttagtgtacaatttagtcatgattctatacacaatgcacctgatgaggcttttatggacataattcgtttgcacagacctgctattgcgtcccgacgtggccttgtgcggtacagtcgcattggacaacgggggtctatgcacactcgcagcggaaagcacataggggcccgcattcattatttttatgatatttcacctattgcacaagctgcagaagaaatagaaatgcaccctcttgtggctgcacaggaagatacatttgatatttatgctgaatcttttgaacctgacattaaccctacccaacaccctgttacaaatatatcagatacatatttaacttccacacctaatacagttacacaaccgtggggtaacaccacagttccattgtcaattcctaatgacctgtttttacagtctggccctgatataacttttcctactgcacctatgggaacaccctttagtcctgtaactcctgctttacctacaggccctgttttcattacaggttctggattttatttgcatcctgcatggtattttgcacgtaaacgccgtaaacgtattcccttatttttttcagatgtggcggcctagcgacagcacagtatatgtgcctcctcctaaccctgtatccaaagttgttgccacggatgcttatgttactcgcaccaacatattttatcatgccagcagttctagacttcttgcagtgggtcatccttatttttccataaaacgggctaacaaaactgttgtgccaaaggtgtcaggatatcaatacagggtatttaaggtggtgttaccagatcctaacaaatttgcattgcctgactcgtctctttttgatcccacaacacaacgtttggtatgggcatgcacaggcctagaggtgggcaggggacagccattaggtgtgggtgtaagtggacatcctttcctaaataaatatgatgatgttgaaaattcagggagtggtggtaaccctggacaggataacagggttaatgttggtatggattataaacaaacacaattatgcatggttggatgtgccccccctttgggcgagcattggggtaaaggtaaacagtgtactaatacacctgtacaggctggtgactgcccgcccttagaacttattaccagtgttatacaggatggcgatatggttgacacaggctttggtgctatgaattttgctgatttgcagaccaataaatcagatgttcctatttacatatgtggcactacatgtaaatatccagattatttacaaatggctgcagacccatatggtgatagattatttttttttctacggaaggaacaaatgtttgccagacatttttttaacagggctggcgaggtgggggaacctgtgcctgatactcttataattaagggtagtggaaatcgaacgtctgtagggagtagtatatatgttaacaccccaagcggctctttggtgtcctctgaggcacaattgtttaataagccatattggctacaaaaagcccagggacataacaatggtatttgttggggtaatcaactgtttgttactgtggtagataccacacgcagtaccaacatgacattatgtgcatccgtaactacatcttccacatacaccaattctgattataaagagtacatgcgtcatgtggaagagtatgatttacaatttatttttcaattatgtagcattacattgtctgctgaagtaatggcctatattcacacaatgaatccctctgttttggaagactggaactttgggttatcgcctcccccaaatggtacattagaagatacctataggtatgtgcagtcacaggccattacctgtcaaaagcccactcctgaaaaggaaaagccagatccctataagaaccttagtttttgggaggttaatttaaaagaaaagttttctagtgaattggatcagtatcctttgggacgcaagtttttgttacaaagtggatataggggacggtcctctattcgtaccggtgttaagcgccctgctgtttccaaagcctctgctgcccctaaacgtaagcgcgccaaaaccaaaaggtaatatatgtgtatatgtactgttatatatatgtgtgtatgtactgttatgtatatgtgtttatgtactgttatatgtgtgtatatatgtgtatgtgtgtatatgtatatgtatgtgttgtgtatatatatgtgtgtgtgtgttatgtgtgtaatgtaatttatttgtgtaatgtgtatgtgtgtttatgtgcaataaacaattaactacattattgtatatcttgttacaccctgtgactcagtggctgttgcacgcgttttggtttgcacgcgccttacacacataagtaatatacatgcacaatatatatatttttgtttccaataatatatttttatatttgcaaccgttttcggttgcccttggcatacactttccaccaatttgttacaacgtgttgcctgttaatcctatatattttgtgccaggtacacattgccctgccaagttgattgccaagtgcatcatatcctgccaaccacacacctggcgccagggtgcggtattgccttactcatatgtttattgccactgcaataaacctgtctttgtgttatacttttatgcactgtagccaactcttaaaagcatttttggcttgtagcagcacatttttttgctcttactgtttggtatacaataacataaaaatgagtaacctaaggtcacacacctgcaaccggtttcggttatccacaccctacatatttccttcttata

SEQ ID NO: 24 - DNA, 7654 bp, Human papillomavirus type 8
aacggtaagtttcatcagtgtaccaggtgcggtatgaaaatttcttaatcataagttgttattgccaacaaccatcgtctatagcatgtttttgcctgtatcgttttcgatcacaccatattgtatattaaataaataaataaatatatatatatattgttacaatgctgtgacttgtgcaattttcctaagcaaatggacgggcaggacaaggcttcatatttagacactaataaggacgagctaccctctactattaaagagttagctgcggctttaggtattccattgcaggactgttcagtaccgtgcaacttttgtggtaactttttggatttcttagaactgtgtgagtttgacaaaaagagactgtgcctaatttggaaaaattacgttgttactgcgtgttgtcgttgttgttgtgtagcaaccgcaacgtttgaatttaatgaatattatgagcaaactgtgctaggcagagatattgaattagctacaggacgttcaatttttgagatagacgttaggtgtcaaaactgcttgtcatttttggatatcatagagaaattagattgctgtgggagaggccgtccctttcataaagttagaggaggctggaaaggagtttgcaggctttgtaagcatttgtatcatgattggtaaagaggtcactgtgcaagattttgtgttgaagttaagtgagatacaacctgaagtgttaccagttgacctgctttgtgaagaggaattaccaaacgaacaggaaacggaggaggagctagacatcgaaagaactgtattcaaaattgttgcaccgtgtggctgcagctgctgtcaggtcaagctacgtctttttgtcaacgcaactgattcgggtatcaggacctttcaagaattgctgttcagagacctacagcttctgtgtcctgagtgccgcggtaactgcaaacatggcggatcataaaggtagtacatctaaagaagggttaagtgagtggtgtattttggaagctgaatgtagtgatgtagacaatgattttgaacaattatttgagcgagatacagactcagatatttcggacttattagataattgtgacctggatcagggaaattctctggaactatttcatcaacaggagtgtgagcagagcgaggagcaattacaaaaactaaaacgaaagtatcttagtcctaaagctgtcgcgcagctcagtccgcggctccagtcaatatcactgtcacctcagcagaaatccaagcgaaggctctttgcagagcaggacagcggagtcgagctaactcttaacaatgaagctgaagatgtttctcatgaggtggaggtaccggctatagactctcggccggaagatgagggaggatcaggggctttagatattgactatacagcattgttgcggtccagcaacacaaaggccacattaatggcaaaatttaaagaggcatttggggatggctttaatgaactaacacgccaatttaaaagttacaaaacttgctgtaactattgggttgtagctgcttatgcagtgcatgatgtatatgaaagctcaaagcagttattgcaacagcattgtgattatatttgggttagaagtatagctgcaattacattatatctattgtcttttaaggcgggaaaaaatcgcggtactgtgcataaactaatgacctcaatgctaaatgtgcaagagcagcagatattgtctgagcctcctaaattgagacacactgctgctgctttgttttggtataaaggaggaatggggacaggaacattcacgtatggttcataccctgattggattgcacatcaaacaattcttggccatcaaagtgctgaagcaagcacctttgatttttctgtaatggtacaatgggcatttgataataatcattttgaggaggccgacattgcttatggatatgcaaaactagccccagaagatgctaatgctgtagcctggcttgctcataatagccaagctaaatttgtaagagagtgtgcagcaatggttcgattttacaaaagggggcaaatgagagaaatgaccatgtctgagtggatatatacaaggatcaatgaggttgaaggagaggggcattggtcttccatagtaaaatttgtaaggtaccagggtataaattttattacatttttagctgccttaaaagattttttgcattccgtacctaagcgaaactgtttgttaatctatggtccacctaatactgggaaatctacatttgctatgtcattaatacaggtgctgaagggtagagtattatcatatgtaaattccaaaagccaattttggttacaacctcttggtgactgtaaaatagcactgttagatgatgtgacagacccctgctggctgtacatggatacatttctgcgaaatggattagatgggcatgttgtgtcattagattgtaaatataaagcacccatgcaaattaaatttcctccccttttgttaacttccaatattaacctgcatgaggaggctaactatagatatttacatagcagagtcagaggatttgaatttccaaatccttttccaatgaaaccagacaatacacctgaatttgaattaactgaccaaagctggaaatctttttttgcaaggctttggacacaattagagctgagtgatcaagaagacgagggcgaacatggagaatctcagcgagcgtttcaatgttctgcaagatcagctaatgaacatttatgaagctgcagaacaaacacttgaggcacagattgcgcattggctgcttttgcgaaaagaagctgtgttgctatatttcgctaggcaaaaaggcatcaccaggattggatatcaacctgtgccgccactagcagtgtctgaagcaaaagccaagcaggctataggaataatgttgcagctgcagtcactacagaaatctgagtttgcagatgagccttggacattagtggacacaagtatagagacttataagaatgctccagaaaatcattttaaaaaaggcgccacacctgtggaggtgatatatgataaacagcctgacaatgccaatgtatacactatgtggaagcacatttactacactgatgcagacgataagtggcacaaaaccaccagtggggttaaccagactggcatatactatatgcaaggcagcttcagacattattatgttgtgtttgctgatgatgcacgtagatatagtgctactggagaatgggaagtaaaaattaataaggacactgtgtttgctcctgttaccagctccaccccccccggatcaccaccaggacaagcagacacagacaccgccgccaagacccccaccacctccgctgactccacgtccagacagcagcggtcccctgcaaaacagccacaacaaaccgaaaccaaaggacgaaggtacgggagacggccgtccagcagaacaagaccgcaaaaagagcagaggcgatcaaggtcgcgacaccgcaccaggtctcgctcccggtcgctctcccgggttagggccgttggctccaccaccgtatccaggtccaggtcctcgtcgctcaccaaggcagttcggccccggtccagatcgcgatccagaggacgggctacagccacctctaggcgaagggcaggtcgagggtcacccaggcgacggcgatcaacctcaaggtcaccctccaccaacaccttcaaacggtcacaaaggggaggagggagacggggaagaggaaggggcagtagggggagacgggaacgatcatcctccacctcccccacccccaccaaacgttcaagaggggagtcttctaggttgcgtggggtctctccttctgaagtgggaagatcagttcaatctgttagtgcaaaacatacagggcgacttggaagactactggacgaagctatcgaccccccagtaatattggttcgaggggaggcaaacacattaaaatgctttcgcaacagagctagagttagatatagaggactgttcaaatactttagcaccacgtggtcatgggtggccggcgatagcactgagcgtctaggcaggtccagaatgctcattctgtttacttcagctggccaaagaaaggactttgatgagactgtgaaatacccgaagggagttgatacatcttatggtaacctggacagtctataacattactaacgctgccttgctactaacacactaacatattcccatttgctttttactatattttttaattgtatactgctatggcgcgtgctagacgggtcaagagagactctgtcacacacatttatcaaacctgcaaacaggcaggtacatgcccccctgatgttattaataaagttgagcaaacaacagttgctgacaatattttaaaatatggcagtgctggtgtattttttggaggccttggtataggtaccggccgtggtacagggggtgttactgggtacacgccattaagtgaggggcctggtatccgtgttggaaatactcccacagtggtacggccctcacttgttccagaagcggtaggtcctatggacatactgccaatcgacactattgaccctgtagagccttcagtctcctctgtggtgccactcactgaatcttcaggagccgacctacttccaggggaagttgagacaattgctgaaattcaccctgtacctgaaggccccaccattgattcacctgtggtgacgacaagcaaagggtcaagtgccattttagaggtggctcctgagccaacccctcctacccgtgtcagagtttcacgtacacaatatcacaacccttcttttcaaatcataactgattccacacctacacaaggagaaagttctctagcagaccacattttagtgacttctggctctggaggccagactataggtagtgacataacagatgtcatagaactgcaagaatttcctagtaggtattcatttgagattgatgaacctacaccaccacggcaaagtagcacacctattgagagacctcaagtagttggtagacgtagaggtatttctttaacaaatagacgactgatacagcaggtggctgttgaggatcctttgtttttatcaaaaccttccaaattagtaaggttcagttttgataatcctgtatttgaagaggaggtcactaatatatttgagcaagatgtggacatggtcgaggagcctccagatagagattttcttgatgttcggcagctagggcgcccacaatactctactacaccagctggctatgtcagagttagcaggttaggcacacgtggcaccattcgcacacgttctggtgcacaaattgggtcgcaggtacatttttacagggatttaagttcaatcaatacagaagatcctatagaactccaactattaggtcaacattctggggattctacaatagtacagggtcctgtggaaagcacttttgtaaatgttgatatttctgaaaatcctttatctgaaagtattcaggcattttcagatgatttactactggatgaaactgtagaggattttagtgggtcccaactggtaataggtaatagaagaagtacaacttcttatactgttcctagatttgaaacaacaagaagtggctcttattatgtgcaagacactaaaggttattatgtggcttatcctgaaagtcgcaataatgaggaaataatttaccctacacctgatcttccggtggtaataatccacacacatgataacagtggtgacttcttcttacatcctagccttcgcagacgcaaacgtaaaagaaaatatttgtgattttgcattacagatggcagtgtggcaatcggctaccggtaaggtttatctgcctccttcaacaccagtggccagggtgcaaagcacggatgaatacattcaaagaactaacatctactatcacgccaatactgacagactgctcactgtaggacatccatatttcaatgtttacaacaataatggtgacacattacaggttcccaaagtatcgggaaatcaacacagggtctttcgcttaaagttaccagatccaaataggtttgcactggcagatatgtctgtatacaatccagacaaagaaaggttggtatgggcttgcagaggcttagaaatcagtaggggacaaccattaggtgttgggagcaccggccatccctattttaataaagtgaaagacactgaaaacagcaattcatacaccacaacatctacagatgacagacaaaatacttcctttgatcctaagcaaatacaaatgttcattgtgggttgcacaccctgcattggtgagcattgggaaaaagccattccatgtgcagaggaccaacagcaaggtctgtgcccacccattgaactaaaaaatacagttattgaagatggggacatggcagatattggttttggtaatatgaactttaagactttacaacagaacagatctgatgtaagtctcgacatagtaaatgagatatgcaaatatcctgattttttgaaaatgcagaatgatgtgtatggtgatgcctgtttcttttatgcacgaagggaacagtgctatgctagacatttttttgtgagagggggtaagacaggtgatgacatacctgctgctcaaattgatgatggcatgatgaaaaatcaatattacattcctggtggacaagatcaatcacaaaaggatataggtaatgctatgtatttcccaaccgtcagtggctcacttgtttcaagtgatgctcaattgtttaacaggcctttctggctgcagcgtgcccagggtcataataatggcattctctgggctaatcaaatgtttgtcactgtggtagacaacacgcgaaacaccaattttagtatttcagtttacactgaaaatggggaacttaagaacatcacagactataaatcaacccagttcagagaatatctgagacatgtagaagaatatgaaatttccctcatattacaattgtgtaagataccactaaaggctgatgttttagcacaaatcaatgccatgaattcatcactacttgaggaatggcaactgggatttgtacctacccctgatactccaattcatgacacctacagatatattgattctcttgccacacgttgtcctgataaaagtccccctaaggaaaagcctgatccatatgcaaagtttaacttctggaatgtggaccttacagaacgactttccctggatttggatcaatattcattaggcaggaagttcttgtttcaagcaggtttgcaacagacgaccgtaaatggtacaaaatctatatctaggggctccgtcaggggcacaaaacgaaaacggaaaaattagattgtaccgttttcggtacaaaaccataaacttttacacagtattcaaggaatgtttgtttattctgactcagcatcactctacctaagaaaccgaccgcacccggtacataaaggtgagtagttgccaaaacagactcagtttagtgccagaatagaccatgttcgttcaaacatgctcggattaggtcgcctgccaaggaagtattgatcttgccaatctattttggcagcgcttttggcatctccaacggaccgtt

SEQ ID NO: 25 - DNA, 7931 bp, Human papillomavirus type 11
cttaataacaatcttagtttaaaaaagaggagggaccgaaaacggttcaaccgaaaacggttatatataaaccagcccaaaaaattagcagacgaggcattatggaaagtaaagatgcctccacgtctgcaacatctatagaccagttgtgcaagacgtttaatctttctttgcacactctgcaaattcagtgcgtgttttgcaggaatgcactgaccaccgcagagatatatgcatatgcctataagaacctaaaggttgtgtggcgagacaactttccctttgcagcgtgtgcctgttgcttagaactgcaagggaaaattaaccaatatagacactttaattatgctgcatatgcacctacagtagaagaagaaaccaatgaagatattttaaaagtgttaattcgttgttacctgtgtcacaagccgttgtgtgaaatagaaaaactaaagcacatattgggaaaggcacgcttcataaaactaaataaccagtggaagggtcgttgcttacactgctggacaacatgcatggaagacttgttaccctaaaggatatagtactagacctgcagcctcctgaccctgtagggttacattgctatgagcaattagaagacagctcagaagatgaggtggacaaggtggacaaacaagacgcacaacctttaacacaacattaccaaatactgacctgttgctgtggatgtgacagcaacgtccgactggttgtggagtgcacagacggagacatcagacaactacaagaccttttgctgggcacactaaatattgtgtgtcccatctgcgcaccaaaaccataacaaggatggcggacgattcaggtacagaaaatgaggggtcggggtgtacaggatggtttatggtagaagccatagtagagcacactacaggtacacaaatatcagaagatgaggaagaggaggtggaggacagtgggtatgacatggtggactttattgatgacaggcatattacacaaaattctgtggaagcacaggcattgtttaataggcaggaggcggatgctcattatgcgactgtgcaggacctaaaacgaaagtatttaggcagtccatatgtaagtcctataagcaatgtagctaatgcagtagaaagtgagataagtccacggttagacgccattaaacttacaacacagccaaaaaaggtaaagcgacggctgtttgaaacacgggaattaacggacagtggatatggctattctgaagtggaagctgcaacgcaggtagagaaacatggcgacccggaaaatgggggagatggtcaggaaagggacacagggagggacatagagggtgagggggtggaacatagagaggcggaagcagtagacgacagcacccgagagcatgcagacacatcaggaatattagaattactaaaatgtaaggatatacgatctacattacatggtaagtttaaagactgctttgggctgtcatttgttgatttaattaggccatttaaaagtgatagaaccacatgtgccgattgggtggttgcaggatttggtatacatcatagcatagcagatgcatttcaaaagttaattgagccattaagtttatatgcacatatacaatggcttacaaatgcatggggaatggtactattagtattaataaggtttaaagtaaataagagcagatgtaccgtggcacgtacattaggtacgttattaaatatacctgaaaatcacatgttaattgagcctcctaaaatacaaagtggcgtacgagccctgtattggtttaggacaggcatttcaaatgcaagtacagttataggggaggcgccggaatggataacgcgccagaccgttattgaacatagtttggctgacagtcaatttaaattaactgaaatggtgcagtgggcatatgataatgatatttgtgaagaaagtgagatagcatttgaatatgcacagcgtggagactttgactccaatgcaagggcctttttaaatagtaatatgcaggctaaatatgtaaaagattgtgcaattatgtgcagacattataaacatgcagaaatgaaaaagatgtctattaaacaatggattaagtataggggtactaaagttgacagtgtaggtaactggaagccaattgtgcagtttctaagacatcaaaacatagaatttattccatttttaagcaaactaaaattatggctgcacggaacgcccaaaaaaaattgtatagccattgtagggccacctgacactgggaagtcgtgcttttgcatgagtttaattaagtttttggggggaacagttattagttatgttaattcctgcagccatttctggctacagccactaacggatgcaaaagtggcattattggatgatgccacacaaccatgttggacatatatggatacatatatgagaaacctattagatggtaatcctatgagcatagatagaaaacatagagcattaacattaattaagtgtccaccgctactggttacatcaaatatagacattagcaaagaggagaaatacaaatatttacatagtagagttaccacatttacatttccaaatccattcccctttgacagaaatgggaatgcagtatatgaactatcagatgcaaactggaaatgtttctttgaaagactgtcgtccagcctagacattgaggattcagaggacgaggaagatggaagcaatagccaagcgtttagatgcgtgccaggatcagttgttagaactttatgaagaaaacagtattgatatacacaaacacattatgcattggaaatgcatacgattggaaagtgtattactacacaaagcaaaacaaatgggcctgagccacatcgggttacaagtagtaccaccattaactgtgtcagagactaaaggacataatgctattgaaatgcaaatgcatttagaatccttagcaaaaactcagtatggtgtggaaccttggacattacaggacaccagttatgaaatgtggctaacaccacccaaacggtgctttaaaaaacagggaaatactgtggaggtaaaatttgatggctgtgaagacaatgtaatggagtatgtggtatggacacatatatacctgcaggacaacgactcatgggtaaaagtaactagttccgtagatgccaagggcatatattatacatgtggacaatttaaaacatattatgtaaattttaataaagaggcacaaaagtatggtagtaccaatcattgggaagtatgttatggcagcacagttatatgttctcctgcatctgtatctagcactgtacgagaagtatccattgctgaacctactacatacacccccgcacagaccaccgcccctacagtgtccgcctgcaccacggaagacggcgtgtcggcgccgcctaggaagcgagcacgtggaccgtccactaacaacaccctgtgtgtggccaacatcagatccgtggacagtacaatcaacaacatcgtcactgacaattacaacaagcaccaaagaaggaacaactgtcacagtgcagctacgcctatagtgcaactgcaaggtgattccaattgtttaaaatgttttagatatagactgaatgacaaatataaacatttgtttgaattagcatcttcaacgtggcattgggcctcacctgaggcaccacataaaaatgcaattgtaacattaacatatagcagtgaggaacaacgtcagcaatttttaaacagtgtaaaaataccacccaccattaggcataaggtggggtttatgtcattacatttattgtaaccattacacctgtatatatgtatatgtgtacataacatacgtgtatggaggtagtgcctgtacaaattgctgcagcaacaactacaacattgatattgcctgttgttattgcatttgcagtatgtattcttagtattgtacttataatattaatatctgattttgtagtatatacatctgtgctggtactaacacttcttttatatttgcttttgtggcttttattaacaacccctttgcaattctttttactaacactgtgtgtgtgctattttcctgccttttatatacacatatacattgtgcaaacgcaacaataatggtgatgttaacctgtcacttaaatgatggtgatacatggttgtttctgtggttgtttactgcatttgttgtagctgtacttggattgttgttactacattacagggctgtacatggtactgaaaaaactaaatgtgctaagtgtaaatcaaaccgcaatactactgtggattatgtgtatatgtcacatggtgataatggagattatgtgtacatgaactagagtaaaccttttttatacagtgtgtggtgtacgttagttatatataatgaaacctagggcacgcagacgtaaacgtgcgtcagccacacaactatatcaaacatgcaaggccactggtacatgtcccccagatgtaattcctaaagttgaacatactactattgcagatcaaatattaaaatggggaagcttaggggttttttttggtgggttaggtattggtacaggggctggtagtggcggtcgtgcagggtatatacccttgggaagctctcccaagcctgctattactggggggccagcagcacgtccgccagtgcttgtggagcctgttgccccttccgatccctccattgtgtccttaattgaggagtctgctattattaatgctggtgcacctgaggtggtaccccctacacagggtggctttactataacatcatctgaatcgactacacctgctattttagatgtgtctgttaccaatcacactaccactagtgtgtttcaaaatcccctgtttacagaaccgtctgtaatacagccccaaccacctgtggaggccagtggtcacatacttatatctgccccaacaataacatcccaacatgtagaagacattccactagacacttttgttgtatcctctagtgatagtggacctacatccagtactcctcttcctcgtgcttttcctcggcctcgggtgggtttgtatagtcgtgccttacagcaggtacaggttacggaccccgcgtttttgtccacgccacagcgattggtaacttatgacaaccctgtctatgaaggagaagatgtaagtttacaatttacccatgagtctatccacaatgcacctgatgaagcatttatggatattattagactacatagaccagctataacgtccagacggggtcttgtgcgttttagtcgcattgggcaacgggggtccatgtacacacgcagtggacaacatataggtgcccgcatacattattttcaggacatttcaccagttacacaagctgcagaggaaatagaactgcaccctctagtggctgcagaaaatgacacgtttgatatttatgctgaaccatttgaccctatccctgaccctgtccaacattctgttacacagtcttatcttacctccacacctaataccctttcacaatcgtggggtaataccacagtcccattgtcaatccctagtgactggtttgtgcagtctgggcctgacataacttttcctactgcatctatgggaacaccctttagtcctgtaactcctgctttacctacaggccctgtttttattacaggttctgacttctatttgcatcctacatggtactttgcacgcagacgccgtaaacgtattcccttattttttacagatgtggcggcctagcgacagcacagtatatgtgcctcctcccaaccctgtatccaaggttgttgccacggatgcgtatgttaaacgcaccaacatattttatcatgccagcagttctagactccttgctgtgggacatccatattactctatcaaaaaagttaacaaaacagttgtaccaaaggtgtctggatatcaatatagagtgtttaaggtagtgttgccagatcctaacaagtttgcattacctgattcatccctgtttgaccccactacacagcgtttagtatgggcgtgcacagggttggaggtaggcaggggtcaacctttaggcgttggtgttagtgggcatccattgctaaacaaatatgatgatgtagaaaatagtggtgggtatggtggtaatcctggtcaggataatagggttaatgtaggtatggattataaacaaacccagctatgtatggtgggctgtgctccaccgttaggtgaacattggggtaagggtacacaatgttcaaatacctctgtacaaaatggtgactgccccccgttggaacttattaccagtgttatacaggatggggacatggttgatacaggctttggtgctatgaattttgcagacttacaaaccaataaatcggatgttccccttgatatttgtggaactgtctgcaaatatcctgattatttgcaaatggctgcagacccttatggtgataggttgtttttttatttgcgaaaggaacaaatgtttgctagacacttttttaatagggccggtactgtgggggaacctgtgcctgatgacctgttggtaaaagggggtaataacagatcatctgtagctagtagtatttatgtacatacacctagtggctcattggtgtcttcagaggctcaattatttaataaaccatattggcttcaaaaggctcagggacataacaatggtatttgctggggaaaccacttgtttgttactgtggtagataccacacgcagtacaaatatgacactatgtgcatctgtgtctaaatctgctacatacactaattcagattataaggaatacatgcgccatgtggaggagtttgatttacagtttatttttcaattgtgtagcattacattatctgcagaagtcatggcctatatacacacaatgaatccttctgttttggaggactggaactttggtttatcgcctccaccaaatggtacactggaggatacttatagatatgtacagtcacaggccattacctgtcagaaacccacacctgaaaaagaaaaacaggatccctataaggatatgagtttttgggaggttaacttaaaagaaaagttttcaagtgaattagatcagtttccccttggacgtaagtttttattgcaaagtggatatcgaggacggacgtctgctcgtacaggtataaagcgcccagctgtgtctaagccctctacagcccccaaacgaaaacgtaccaaaaccaaaaagtaatatatgtgtgtcagtgtgttgtgttatttatatgttgttgtagtgtgtatatgtttcttgtattgtgtatatgtgtatatgtttgtgtatatgtgtatgttatgtatgttatgttgttatgtatgtttgtgtgtttagtgtgtgtatatatttgtggaatgtgtatgtatgtttttgtgcaataaacaattattatgtgtgtcctgttacacccagtgactaagttgtgttttgcacgcgccgtttgtgttgccttcatattatattatatatatttgtaatatacctatactatgttacccccccccacttgcaaccgttttcggttgcccttacatacacttacctcaaatttgttataacgtgttttgtactaatcccatatgttgtgtgccaaggtacatattgccctgccaagtatcttgccaacaacacacctggccagggcgcggtattgcatgactaatgtacaataaacctgtcggtttgtacaatgttgtggattgcagccaaaggttaaaagcatttttggcttctagctgaacatttttgtacccttagtatattatgcacaatacccacaaaatgagtaacctaaggtcacacacctgcaaccggtttcggttacccacaccctacatatttccttcttata

SEQ ID NO: 26 - DNA, 7880 bp, Human papillomavirus type 13
gtttctaacaatcttaagtttaaaaaataggtgggaccgaaaacggttttaaccgaaaacggtgatatataaaccagcccaaaaattgagcaagcggggcataatggaaagtgcaaatgcctccacgcctgcaaaaactatagaccagttgtgcaaggagtgcaacctttctatgcacagcttgcaaattctatgcgtgttctgcaggaaaaccctgtccacggcagaggtttatgcatttcagtataagagtttatatatagtgtggcgaggacagtttccatttgcggcttgtgcatgctgcttagaaatacaaggaaagattaaccagtttaggcattttgacttcgcgggatttgctgtaacagttgaagaagacacaaagcagtcaattttggatgtgctaattcgctgctatttatgccacaaaccattgtgtgaagtggagaaactaagacatattttgcagaaggcacgatttattaaattaaacagcagttggaaaggccgctgttttcattgctggtcatcatgcatggaaaatatcctaccttaaaagacattgttttagagctgactcctgaccctgtaggtctacattgcaatgagcaattagacagctcagaagacgaggtggacgaacaagccacgcaagccacgcaagccacgcaacatagcacactattacaatgctaccaaatactaacgtcctgtagtaaatgttgtagcaacgtccggctggtggtggagtgtacaggacctgacattcacgacctacacgacctactgctgggcacgctgaatatagtgtgccctttgtgtgcaccaaaaagctaaccacgatggcagaggatacaggtactaataatgaggggacgggatgctcaggatggtttttagtagaggctgtagtagaacgaacaactgggcaacaaatatcagatgatgaggatgaaacagtggaagatagtgggttggatatggtggatttcatagatgacagacctattacacacaattccgtggaagcacaggcattgttaaacgagcaggaggcggatgctcattatgcggctgtgcaggacctaaaacgaaagtatttaggcagtccatatgttagtcccctaggacatgttgaacagtcagtggactgtgatataagtcctcgattggacgctataaaattaagtagaaattctaaaaaagtaaagcgacggctgtttcaatcaagggaaataacggacagtggatatggctattctgaagtggaagctgaaacgcaggtagagagaaatggcgaaccggaaaatgattgtgggggtggtggacacggaagggacaaagagggggagggacaggtgcacacggaagtgcacacaggcagccagatagaagagcacacagggaccacgcgggtgttagaactccttaaatgtaaggatgtaagggctacattgtatggtaagtttaaagactgttatgggttatcatttacagatttaattagaccatttaaaagtgataaaacaacatgtggggactgggtggttgcagcatttggtatacatcatagtgtatcagaggcatttgaaaagttaatgcagccattaacaacatatatgcatatacaatggcttacaaatgcatgggggatggtattgttagtattaataagatttaaagtaaataaaagtagatgcacagtggcgcgaacactggcaacctttcttaatattcctgaggaccacatgttaattgaacctcccaaaatacaaagcagtgtggcagcattatactggtttagaacaggtatttctaatgctagtatagtaactggtgaaacaccagaatggataaaaaggcaaacaattgtagagcatggacttgcagataatcaatttaaattaactgaaatggtgcagtgggcatatgataatgatttttgtgatgaaagcgaaatagcatttgaatatgcacaacgaggagattttgattcaaatgccagggcatttttaaatagtaattgtcaggcaaaatatgtaaaagattgtgcaacaatgtgcaagcattataaaaatgcagaaatgaaaaaaatgtctatgaaacaatggataacatatagaagtaaaaaaatagaggaagcaggaaattggaaaccaatagtacaatttttaaggcatcaaaatatagaatttattccatttttaagtaaattaaaattgtggcttcatggcacgccaaagaaaaactgtattgcaatagtggggccaccagatacaggcaaatcatgtttttgcatgagcttaattaagtttttagggggcacagtaattagttatgtaaattcaagtagccatttttggctgcagccattatgtaatgcaaaggtagctttgctagatgatgcaacgcagtcatgctgggtatatatggacacatacatgagaaatttattagatggcaatccaatgagcattgatagaaaacataagtctttagcattaataaaatgtccgccattattagtaacatctaatgtagacattaccaaagatgacaaatataaatatttgtatagtagagtaacaacacttacatttccaaatccattcccttttgacagaaatgggaatgcagtatatgagttgtctgatgcaaactggaaatgtttttttacaagattgtcagcaagcctagatatacaggactctgaggacgaggacgatggagacaatagccaagcatttagatgcgtgccaggaacagttgttagaactgtatgaagaaaatagtaatgaacttaaaaaacatatacaacattggaaatgcttaaggtacgaaagtgtactcttacacaaagcacgccaaatgggcctaagccacattggattacaagtggtgccaccattgacagtatcacaagctaagggacatgaggcaattgaaatgcaaatgactttagagacattactagagtctgagtttggtatggaaccatggactttacaagatacaagtcgtgaaatgtggctaacacccccaaaacgctgttttaagaaacagggacaaactgtggaagtaaaatatgactgtaatacagacaatagaatggattatgtgtcgtggacatacatatatgtgtttgacacagataaatggacaaaggtgaaaggaatggtagattataaagggttgtactacatacatggaaatttgaaaacatattatttagagtttgaaaaggaggctaaaaaatatggggaaacgttacaatgggaagtatgtattggcagcacagtcatatgttctcctgcatctgtatctagtactgtacaagaagtatccattgctgggcctgcttcatactccaccaccacctccacacaggcctccaccgcagtgtcctgcagcgcctcggaagaatgtgtgcaagcgccgccttgtaaacgacaacgaggaccttcacgtcccattggaaacccccagaacacacaaagcattgtgtgtgtcacagactacgacaccctggacagtgcaaacaacaacatcaacgttaaccattacaacaataacaaaggacgggacaacagttactgtgcagctacacctatagttcaattacaaggtgactctaattgtctaaagtgttttcgatatagattacatgaaaaatataaagatttatttttgttagcatcatctacatggcattggaccgcccctaataattcacaaaaacatgcactggtaaccttaacctatgtaaatgaacaacaaagacaagactttttaaaaactgtaaaaatacctccaaccataacacataaactaggttttatgtcattgcaattgttataacagcatatattgtatgtaaatatttgttgtgtgtgtgtatatattgtaaatggaatttatacctgtggatgttagtacacaggcaaccagcaagtcattactgccacttgtaattgcacttacagtgtgtgtagttagcattataacaatattgtgcatatcagagttcttggtgtacacaaacgttttagtactaacattaattttatatgtacttttgtggcttttactaacaactcccttgcaattctatttactaaccctgtctctttgctttcttcctgcgttgtgtgtacaccaatatattttacaaacacaagaataactatacacaatgttaacctgtacttttgatgatggtgacacatggttgctattatggttaattttatcatttattgtagccattctagggttactgttgctgtatataagaactggacatatgcattgccagtgctggagtaaataagtggttttatattttgtgtgtattcatttaattatggcacatagtagggctcgcagacgcaaacgcgcttcagctacacaactatatcaaacttgtaaggcttctggaacatgtcctcctgatgttataccaaaggttgaacaaaacactcttgcagataaaatattaaagtggggcagtttaggagtattttttggggggcttggcattggcacaggctctggtactggcggtaggactggctatgtaccagtaggatccaccccacgccctgccatatcaactgggcctactgcacgtcctcctattgttgttgatactgttgggcctacagacccttctattgtatctttggtagaggaatcagctattattaattctggagtacctgaccctttgcctcccgttcatgggggttttgaaatcaccacatctcaatcagccactccagcaatattggatgtgtctgttacaacacaaaacactacgtccacaagtatatttagaaatcctgttttttcagaaccttctattacacaatctcaaccttctattgaaagtggtgcacacgtgtttatatcgccatctactatttcccctcattctacagaagacattcctttagatacatttattgtatcttcctcagatagtaatcctgcatcaagcacccctgttccagcaactgttgcacgtccacgtctaggcctttacagtagggccttacatcaagtacaggttactgatcctgcctttttatcgtcgccccaacgccttataacctttgataaccctacatatgaaggtgaagatataagtttgcagtttgcacacaataccattcatgaaccccctgatgaggcatttatggatattataagactacataggccagccataacatcacggcgtggtcttgttaggtttagtagaattggtcagagggggtctatgtatactcgaagcggcaagcatataggtggaagggtccatttctttaaggatatttctcctatatctgcagctgcagaagaaatagaattacacccccttgtggctgctgcacaggatcacagtggtttgtttgatatttatgcagaacctgaccctgaccctgtggctgtaaacacctctgggtcattgtcttctgcctccacaccatttgcacaatcttctttgtcttccgccccatggggtaatactactgttcctctttcactaccaggtgatatatttatacagcctggtcctgacataacattcccaactgcacctacagtaacgccttataatcctgttacgcctgctttacctacaggtcctgtttttattactgcttctggattttatttatatcctacatggtattttacacgcaaacgccgtaaacgtgtttccttgttttttacagatgtggcggcctagtgacaacaaactatatgtgcctcctcccgcccctgtatcaaaagtaattactacggatgcctatgttacacgtaccaacatattttatcatgctagcagttctagactacttgcagtgggaaatccttattttcctattaagaaacaaaacaaaactgttgtccctaaggtatctggttatcagtttagggtatttaaagttgtattacctgaccctaataaatttgccctgcctgacacatctatatttgactcaactagtcaacgcttagtgtgggcctgtacaggtttagaggttggtaggggtcaacccttaggtgttggtattagtggtcatccattattaaataaatatgatgatgtggaaaattctgcaagttatgctgccaatcctggtcaggataatagggttaatgtggccatggactataaacaaacacagttatgtttagtgggctgtgcacctcctttaggtgaacattggggacagggcaagcaatgtactggtgtaaatgtacaacctggagattgccctcctttagaattaattagtagtgtaattcaggatggtgacatggtggatacaggatttggagccatgaattttgcggaattgcaatctaataaatctgatgtgccactagacatatgcacgtccacatgcaaatatcctgactatttacaaatggctgcggatccttatggagacagattatttttttatctgcgaaaggaacaaatgtttgcaaggcatttctttaacagggcaggctctgttggtgaacaaatcccagcagaattatatgttaagggtagtaatacactttctaatagtatttactataatactcccagtggctctcttgtgtcttctgaggcccagttgtttaataaaccttattggttacaaaaggcccagggacacaataatggtatatgttggggcaatcacttgtttgttactgtagttgatactacacgcagtactaacatgactgtgtgtgcagccactacatcatctctttcagacacatataaggccacagaatataaacagtacatgcgacatgtagaagaatttgatttacaatttatttttcaattgtgcactattaaattaactgcagaggttatgtcatatattcatactatgaatcctacaattctagaagactggaactttgggctatctccccctcctaatggaacattagaagacacatatagatatgtacaatctcaggccataacgtgtcaaaagcctacacctgataaagaaaaacaggatccgtatgcgggtcttagtttttgggaggttaatcttaaggaaaagttttctagtgaactagatcagtatccccttggcagaaagtttttattacaaacaggcgttcagtctaggtcccctattcgtgtaggtaggaaacgtgctgcatctacatctactgccacacctactacacgtaaaaaagctaaaaggaaataatagtttgtttatgattgtgtatgtatgtcacgtttgtttgtactgtatgtatgttgtgtactgtatgtgtaatgttgtatgtatgtgcatgttacttattaaagaatgtgtgtgtgtgtttgtatgcaataaatctaatctgtggtgtcctgttccaccctatgagtaagtggtatgttgtgtctcgtgtggtgttttgtatactatactataacattagtgcaaccattttgtaacttttcttacattttacgtctccatattaagtgcaaccgatttcggttgctattgtttctgcgaccgatttgttgcagcacgctgtttatataatcttacctaccgcctgccaaaattatccaccgcttgccaaaatcacccacacacctggcgttgctagggcgcggttatatatatttactaaatcttactaatctttctatcactcattttacctttataacaatacttttgcttttcaagtacatttttgtacttactagccaatgcctgaaaggttttttggctaccagcactacatttttgtacagttaatgttacatgtataaaatgagtaacctaaggtcacacacctgcaaaccggtatcggttaaaacacaccctctatagttccttataatt

SEQ ID NO: 27 - DNA, 7852 bp, Human papillomavirus type 30
tgaaagttacaagcatagtttatagaaagggagtgaccgaaataggttttcaaccgaaaacggtacatataaaagcactgtaccaaacggacagtgtacccatggctttcaaatttgaaaatacaggcgagcgcccacgtactgtgcaccatctttgtgaggtacaagaaacatcgttgctggagctacagctacagtgtgtatattgcaagaaggaattatccagctcagaggtatataattttgcatgtaaagatttaagactggtatatagggaggacagcccatatgcagtgtgcaatttctgtttattattttatagtaaagtaagaaagattagacattacaactattcattgtatggggcaagcctagtggcattaactaaaaaagagttatttgatttattaataaggtgctacagatgtcaacagccgttgacaccagaggaaaaacagttacactgtgaatataagaaacggtttcacagaatatcacgtacgtggaccgggttatgtctgcaatgctggagacacacaacgtccactgagacagcagtataatcatgcacggtaaagtaacaactattccagaatatattttggaccttgtaccgcaaactgaaattgacctgcattgctatgagcaattgaacagctcagaggaagaggatgaggatgaagtagacaatttacagaagcagccacagcaagctagacaagaagaacaacatccttgttacctaattaacacacagtgttgtaggtgtgcgtctgcggtgcagttggctgttcagagtcccacaaaggagctgcgtgccctacaacagatgcttatgggcgcactggagctagtgtgtcccctgtgtgcaacaaggcggtaaacggcaatggcgtcacctgaaggtacagatgatgagggaggggggtgcacgggatggtttcatgttgaggctgtagtcaagaaacgtacgggagatataatatcagaggacgaaacagaagaagatgagggcacagcatcagatttagatgggtttctagacaatagtaatgtaataacaacacaggcagacagggagacagctcagcagttattgcatgcccaaaacacatatgcagatacacagacgctgcacaatttaaaacgaaagtatttaggcagtccgttgggagacattagtaatcagcaatttgtgtgccgggaaggagtaaaacgaaggataattgatacagacgtggccgacagcgggtatggcaatactttggaagtggaagcaacgcaacaggtacaggataatacgtatggtagtggtaaacagcaagatggaggctcacagactagtgtgtgtagcagggaaaacagcatagaagcagacagtgatatggatataggcgccacgccaccacagcaaatacaagaattattaaaatctagtaatgtacaggcaaagctgtgttataaatttaaagagttatttggaattccattttcagaattggtacgtacatttaaaagtgacagcacatgttgtcatgactggatatgtgccatgtttggtgttaatgaaaccttagcagaggcattaaaaacaattattaaatcacagtgcatgtattaccatatacagtgtttaacgtgtacatggggcgttgtaatattaatgttaattagatatacatgtggaaaaaatagaaaaacaattataaaatcactaagttcaattgtaaatgtgcccagcgaacaaatgcttgtgcagccacctaaaatacgtagccctgccgttgcattatacttttacaaaactgcaatgtctaatattagtgacatatatggtgagacaccagaatggatacagcgacaaacacaaatacagcacagttttcaggactgccaatttgaactgtcgaaaatggtgcaatgggcatttgataatgacgtaacagatgacagtgacattgcattttactatgcacagttagcagatgtagatagtaatgcacaggcttttttaaaaagcaatatgcaggccaaatatgtaaaggattgtggaataatgtgcagacactataaaagagcacaacaacaacaaatgaacatgaaacaatggattacacacatatgtagtaaagtagatgagggcggggactggaggccaattgtacagtttttaagatatcaaggggtcgacttcatttcatttttaagttattttaaattatttttacgaggcacaccaaaacacaactgcctagtattatatggaccaccaaacacaggaaagtcatgttttgctatgagccttatacaattttttcaggggtctgttatttcatatgtaaattcacacagtcacttttggttacaaccgttagacaatgctaaattgggaatgctagatgatgccacagatgcatgctggagatatatagatgaatatatgcgaaatttattagatgggaatcctgtaagtttagatagaaaacataaacaactagtacaaataaaatgtccaccagtaataataacaacaaatattaatccactgcacgatgcaaaattgcagtacttgcacagtagaatacatgtggtgccatttctaaatccatttccaattgatacaaatggtaatcctgtatatcaattaaataatgtaaactggaaatgtttttttgaaaggacatggtccagattagatttgaacaacgacgaagacaaggaaaaccatggagactctatgccaacgtttagatgcgtgccaggagaaaattctagactgttttgaaaacgatagtaaaaaaattgaagaccatatagtgtactggaaagctgtacgacatgaaaatgttgtattatataaagcaagacaaaataatattactaaactacgccaccaggtggtgccatgtttacaagtgtgtaaagcaaaggcatgtgttgctatagaaatacaaatggcattggaatcattatataaaacagagtataaagtggaggagtggacattaaaagatgtatgtgaaaatatgtggcatacagcaccaaaacagtgttttaaaaaaagtggaaaacgtatagaagtgtggtttgatgggaaaaaagacaatcgaactgaatatgttgtgtggcaatgggtgtattactgtggggacaatgggtggactaaagtgccttctgtagtagattacaaaggtatatattatgtacatgacggtaacaaagtatattatacagactttaatgacgaggcagtaaagtatgggtataaaggcacatgggaagtgcatatgggaaatgaaagtatttattgtcccgactctgtgtctagtaccctcagatccaacgtatcccctgttgaaactgttgtcgaatacaacacctacaacacctatcaaacccccaccacctccacgcccgtgggcgccaacgaagccgcgtcctccgcacggccgggaaaacgtcctagaaccacagagcccgacagtacagacaccaccagacagtccgctgccagagagtcccacgcaaaccgtgtcaacacaaacaacacaaacaacagacagtgccttggtggagctacatgttacaacacagaagtcgacggtggttataaaactacacctgtagtgcatttaaaaggtgaaccaaacagattaaagtgtttaagatataggtgtcaaaaacataagcacctatttgtaaatatatcgtctacatatcattggaccaatacacatacagagtacagctacattactgttgtatataaagatgagacccagcgtgccaactttttaaatgttgtaaaaataccacccagtataaaaattgtaatgggacatatgacaggtgttgatatgtaacaacacatatgttgtaattggtacaacaaacatgtaatattgtattccacatgtaaatattattgtgtactatagttatacaacaacaaacgccatattttgctgctacgcctgttatatattgcaaccattgttttatttgttagttttgtgtttttgctttgctgttttgtgtgcctgtgtgtctgcctatatgtgccgcttttgctgtctgcctcgttgttttctacctgtttattacttataatattgttttggtttgttgttgcatcgtcctacattactgcatttactatatttttgctgtttttttatatacctttattacttgtatatgcccatgctgtgtggttaataaacacacaataaattgttttgtaacatattacacttttgctttgtgtagggcgtgtactatggtcgcccaccgggcacgcagacgaaaacgggcctctgctactcagctgtatcaaacgtgcaagcaggctggcacatgtccatctgatgttattaacaaaattgaacacacaactttggcagataagatattacaatggggtagtttgtttacattttttggtaatttaggtataggcactggtgcaggctctggggggcgtgctggttatgttccgttaggtacacggcctacaacagttgtggacgcatcccctgctaggccacctattgttgttgaatctgtgggtcctacggacccttccattgttacactggttgaggagtctagtgtggttaatgctggagcatcattccctaattttacaggcactgcaggctttgaggttacgtcttcctctaccacaacacctgctgtattagacattacacctaccactggctctgtccatgttagtagtacccattttaccaatccctcctttgttgaacccccagttattgaggttccacaaactggggaggtatccggccatatattggttagcactcccacatctggtgtacatagttatgaagaaatacctatgcaaacatttgctgtgcatggtacaggcactgaacctattagtagtacccctattcctgggttacgacgtatagctgcccctagattgtatcaaagggcctttcagcaggtaaaggtcactgaccccacattccttaccaaacctgaaacattaattactgtggataatccagtctttgaggatgctgacacaactttaaccttttcaccatcgggtgtggcacctgatcctgactttttagatattgtggctttacacagacctgcctttacaacacgtaggggtggtgtgcgttttagtaggcttggtacaaaggccacaatgcgcacaagaagtggcaaacaaataggtgctcgtgtacattattattatgatgtgagtcctattgcacacactgaggaaattgaaatgcagccattattgtctgcaaataattcatttgatggcctatatgatatttatgcaaaccttgatgatgaggcgccagtgtcatctcacctatccattgctacaccgtcccggttgcctaccaacactgttcctttgtcctttagtagtcaaactaccaatgttactatacctttgggtaaatattgggatgttcctatttattcgggccccgatatagtattgcctactggtcctaccacatggccctatgcccctcaggccccatttgacactacacatgatgtggttatacatggatctacatttgctttatggcctgtatactttttaaggcgtaggcgtcgtaaacatgttccctattttcttgcagatggcggtgtggcggcctagtgaaaccaaggtttacctgcctcctacacctgtatcaaaggtggtaccaacagatgcatatgtaaagcgcaccaatatattttatcatgcaggcagctcacgtttgcttgctgttggacatccatattattctatttctaaggctggtaattccaaaacagatgttcccaaggtgtctgcatttcagtatagggtctttagggtccgcttgcccgatcccaataagtttgggttacctgataccaatgtatttaatcctgagcaggagcggctggtatgggcctgtgtgggcctggaaataggccgtggccaacctttaggtgttggtgttagtggcaatcctttatttaataaattggatgacactgaaagttccactatagctaatcaggatacagcagaggatagtagggacaacatttctgttgatccaaagcaaacccaattgtgtattattgggtgcactcctgctataggagaacattgggctaaaggcactgcctgtcgttctgcgccccctgcacaaggggattgtcctcccttggaacttgttaattctcctatacaggatggcgacatggttgatattgggtttggtgccatggattttaaaacattacaggaatctaaatcagatgtgcctttagatatttcacaatccacctgtaaatatcctgattatttaaaaatgagtgcagacgcctatggcgattctatgtggttctatttgcgtagggaacagttatttgctaggcactactttaatagggcaggtgctattggtgaacaattacctagcacattatatataaaaggtacaaataacagggatcccccgccaagctcagtatatgttgctactcctagtgggtctatggtaacctctgaggctcagttgtttaataaaccttactggttgcaacgcgcacagggacacaataatggcatttgttggggcaaccaggtatttgttactgttgtggacaccactaggaacacaaacatgactatatctgcaaccacacaaacgttatccacatataattcaagccaaattaaacagtatgtaagacatgtagaggaatatgaattacagtttgtgtttcaactgtgtaaaatttcactgtctgcagaaactatggcctatttacatactatgaactccactttacttgagggctggaatattggattgtcacccccagctgccacaagcttagaggacaaatacagatatgttaaaagccttgctataacctgtcaaaaggatcagcctcctgctgaaaaagaggacccactagctaaatataagttttgggatgttaacttacaggacagtttttctgctgaccttgaccaattcccactgggcagaaagtttttaatgcaacttggggttcgtactaaaccttctactactactaaaaaacgctcggcccccagttcctctacctctacaccatcagccaaacgcaagcggcggtgattgtttgtgtctgtgtatgtttccttactatttattgtgcatgaatgtatgtttttgtatggatgtatgttttgtttatatgtttctgtatgactgtatgtatgtgtaatgactgtatgtatgtaataaatatgaatgagtcttacttttacgtgtggttacataaactaaggtgcggttgtgtccctaggcatttaggtagcaatttaggtggcgtccctatgtcctccaccctttttggttgttgcacaccactgtgcagttactttttatatttatattataccaccacagtagtgtccattttatgcatttgtgccctccattttacctttcaaccgatttcggtttcctggcatgtatgagtgttttttatatgtacatgccaaaagtacattcagcaaaacacttaatccactggcatggtgccgtttcctgcactttatgtttttttttgcaacgtaagacgcctcgccttattagtcatatatgtatgctgccaactatgcttttatcagcatactttactgctgttgggcataagtttttattgcaaacatctgcaacacaatgatttggcttgcagcatatattttggtagccaactatgtgtcttgtaaagcaggtgtgtaaaaccttactcatatcccacaaccggttacggttttgcagcaacaagtttattttataattat

SEQ ID NO: 28 - DNA, 7723 bp, Human papillomavirus type 34
actataatcctactataaaatatagggtgtaaccgaaaacggttgcaaccgatatcggtgcatatataagtgctgcagtacactgctggacagattgggaaatgttttttcccaatcctgaggaacggccatacaagctaccagccttatgtgaagaggtcaacatttcaatacatgaaatagaattggactgtgtgtattgcgaacgacaactgtacagatgtgaggtatatgattttatatttagagatttatgtgttgtatatagaaaggggaaaccacttggggtatgtcaaccgtgtttactgttttactcaaaggttagacaatatagaagatataaccaatcagtgtatggacggacgttagagaatttaactaacaaacagttgtgtaatattttaataaggtgcggaaaatgccaaaaaccactgtgtccattggaaaagcaaaggcatgtagatgaaaacaaacggtttcaccaaatagcggatcagtggaccggacgctgtacacagtgctggagaccatctgcaacagtggtgtaagaatgcatggaaaaaaaccaagtgtgcaggacattgtgttagatctgaaaccaacgaccgagactgaccttacatgttacgagtcattagacaactcagaggatgaggatgaaacagacagccatctagaaagacaagctgagcaagcctggtacagaatagttactgattgcagcagatgtcagtccacagtgtgtcttaccattgagagcacacacgctgacctattagtgttagaagacctgcttatgggtgcactaaaaattgtgtgccccaactgttccagacgcctataacagaagatggctgattcaggtaattgggaagggaggtgttcgggatggtttaatgtagaagccattgtagaaaggaaaacaggggatgcaataccagcagatgaaaattatgatggggacgatacagaggattctgaaatgggggattttattgataatgcacacatatctaatatatattcacagcaggaaattgcacaggcattatatcactcacagcaagttaatgcagacaatgaggctatacgtgttctaaaacgaaagtttgcaggtagtgctggcagtagcccagacagtaaaagacatgaattgaaacacaaacagcgtagtccacatatattgacgataagggacactaatactacatctacacacctattgtgtgaggaacaagacagcggatatggcaatactgaagtggaaacgtacgagagacaggtaccggggccggggggatgtttacaaagtactagcagtagtaacaacggcagccaaatggcgtcgccaggggaaacaaatagtgggtccagtagcatttcaaatatggatatagacatggaaagcacacctataacggacattacaaacatattaaaaagtagtaatgtaaaggcaacattattagcaaaatttaaagaggtatatggattaagttatatggaattagtaaggccttataaaagtgataaaacacagtgtcaggactgggtatgtgcagtgtttggggtagcgccatcattggcagaaagtttaaaatcattactaacccaatattgcctatacatacatctacaatgtttaacatgttcgtggggtataatagtattattgttagcaagatttaagtgcaataaaaatagattgacagtacaaaaattattacatgggttattaaatgtaacacaggaatatatgttaatagaaccacctagactaagaagcacgccatgtgcattatactggtacagaactagcctatcaaacattagtgaaacggtgggagaagtacccgaatggattaaaagacaaacagtagtacagcacagcttagaggactgtcaatttgacctatctcaaatggtacagtgggcatttgataatgacataacaaatgactgtgaaatagcatataaatatgcattattagcatctgaggatagcaatgctgctgcatttttaaaaagcaatgcacaagcaaaatatgttaaggattgtggaacaatgtgtagacattataaagctgcagaacgtaaacaaatgactatgtcacaatggattacacatagatgtgatttaatagatgatggaggaaactggaaacatattgtgcaatttttaagatatcagcaggttgaatttgtaccgtttttaattgctttaaaacaatttttaaagggtataccaaaacaaaattgtatagttatatatggaccaccagatacaggaaagtcacattttggaatgagtttaatgcagtttatgcaaggtgtggttatttcatatgtaaattccaatagtcatttttggttatcgccattggctgatgcaaaaatggcattattagatgatgcaacacctgcatgctggacatatattgatagatatttaagaaatgcattagatggcaatcctatgtgtttagacagaaaacataaacatttattacaaattaaatgtcctccattactaataacatcaaatacaaatcctaaagcagatgatacctggaaatatttgcacagtagaatgaaagtgtttacgttttcaaatccatttccatttgacagtaatggaaatccactataccaacttactaatgaaaactggaaggcattttttacaaagacgtggtcaaaactagatttaacagaggacgacgacaaggaaaatgatggagacactgtgcaaacgtttaagtgcgtgtcaggacgcaatcctagaactgtatgaacgtgatagtatacatttaagtgatcatattgatcactggaaacacgtgcgactggaaaatgtattattacataaggcacgtgaaatgggactgcaatcagttaaccaacaagcggtgccaagccttgcagtatcacgatccaaagggcataatgcaattgaactacaattagccctagaaagtttaaatgaatcaagctataacacagaagaatggacattacaacagacaagttgggaacagtgggtaacggacccaaaacaatgttttaaaaaaggtggaaaaacagtagaagttagatatgactgtgacaaggacaacaccatgcaatatgtggtatggacatttgtgtattattggttggaaggcaagtggtataaagtgagtagccatgtagattataatggtatatattatgaaacacaggacaatgaaaaggtatattatacacaatttgacagagatgcaaaacgatatggggttaaaggaatatgggatgtatgtatgggcggtaaggtaatatgttttgctcctgtatttagcccgtgtgaagtatccactcctgaaattgttagacccctgcacacaagcaacagcagcaacgcacaggacgcgggtgtgccaacacggaaacggcatagacagtgtgacccagacgaggggcccttggactttgtacataacctacagcccacaacagactcatcgacccagtgtactctacataatgttgcgccaatagtacatttaaaaggtgacaaaaacagtttaaaatgcttaagatataggatgcataaagggtattcacatttgtttaataatgtaacaactacatggcattggaccaataatacaaatagtaaatgtggtgtaattacatttatgttttccagtacatcccaacaaaaacaatttttacaatgtgctaaaataccaccaactatatcagtgtcatcagggtatatgtccatataacacaaatatgtaacattggttacaattgtatacattggtatactgtataatgtcatgatcatttttatatttgtaattttgtttgtctttggcttttatatgtgcctgtctgtgtcgcttgcagtgtctgtgtgtgtttatgcatggttattgcttttgattataattacttttttacatgtgtcccaatccctgttaaaagtatatatattatatgtgtgtgtgttttatattcctatggcactggtacattaccatgctaccttgcaagtaacataaatattttcatatatatacaataaatttattgtttgtgtaccagtgtgtagtttaccatgcgtcgcaagcgtgacacacatataagacgtaaacgtgcatcagccacacaattatacaaaacatgtaagcaaagtggcacatgtccccctgacataattccaaaggttgagggcaatactttagctgaccaaatattaaaatatggtagcattggggtattttttgggggtttgggtattggtagcgggtcaggaaccgggggtcgtacaggatatgtgccattacccacaactactccatctagaccagttgaaattcctttgcaacctaccagacctcctgttattacatctgtaggggcctctgattcttctatagtttcattagtggaggagtcaagttttattgaagctggtgtgccaggtcctacctccatagtgccttctagttctggatttaatgtaacaacatctgtggacagtacacctgctattatagatgtggcaactataagtgacactacacaagtatctgttagtacatttaacaatccaacttttactgacccatccgtgttgcaacctcctccacccttagaggcctctggcagacttttattttcaaatgatactgtaactactcattcttatgaaaatatacctcttgacacatttgtagttacaacagataacaatagtattgttagtagtacgcccattccagggaggcaccctcctgcacgcttagggctttatggacgtgctatacaacaggttaaggttgtagaccctgcttttgtaacaacgcctacacgtttggtaacatatgataatcctgcctttgagggcctgcaagataccacattagaatttcagcacagtgacttgcataatgctcctgactctgattttttagatattgtaaagttacataggcctgctttaactgctagaaaaactggcatacgtgttagtagactaggacaacgtgccactatgtttactagaagtggcaaacgtataggtggtagggtacatttttatcatgatttaagtccaatacctacggaaaatattgaactgcagcctttactgccttctgcatctgctactgtaacagatgctaatggcattaatgatgggctatatgatgtattgttagataataatgtagatattactgaagtggaaacacctactggtacaaacacacaaagtgtttttgcaagtgagatttccactacaactgcaaataccactattcctttaaatgctggtttggatacacatcctggccctgatattgctttacctgtacctactgcagaaaccatttttaccccaactgtacctgtacagccttctggtcctatatatatatatgggtccgattttatattgcatcctagcttgtatgtcattccacgcaaacgtaaacgtttgtcatatttttttgcagatgtggcgacctactgaggcaaaggtatacctgccccctgtgtctgtatctaaagttgtaagcactgaagagtatgtaacacgcacaaatatatattattatgcaggtagtacacgcttgctggcagtaggacatccctattatcctataaaggatactaatgggaaacgtaagattgctgtacctaaagtttcaggtttgcaatacagggtatttagaatacgtttgccagatcccaataaatttgggttcccagatgcatctttttataatcctgacaaggagcggttggtttgggcctgtgcaggcgttgaggttggacgcggacagccattaggtataggtactagtggtaatccttttatgaataaacttgaggatactgaaaatgctgcaaaatatattggtggaaacatagcagatagtagggagtgtatgtcagtagattataaacaaacacagttatgtattgtaggctgtaagcctcccttaggggaacattggggtacaggcacaccatgtggtacccaaaatgctggggaatgtcctccgcttgaattaaagaacaccactatacaggatggtgatatgattgatgtgggctttggtgccatggattttaaggccttacaggcaaataaaagtgatgtgcccattgatatttccaacactatatgtaaatatccagattatctaggcatggccgcagatccctatggcgattctatgtggttttatattcgtagggaacaaatgtttgttagacacctatttaacagggcaggtactgtaggcgatgctattccagatgacttaatgattaagggtacaggcaatactgcatcgccatccagttgtgtgttttatcctactcctagtgggtctatggtatcctcagatgcacaaatttttaataagccttattggttgcaaaaggcccagggacaaaacaatggcatttgctggcataatcaactgtttttaactgttgtagatactactagaagcacaaacttttcagtttgtgtaggtacacaatccacaagtacaactgcaccatatgcaaacagtaattttaaggaatacctcagacatgcagaagagtatgacctgcagtttgtgtttcagttatgcaaaatcaatttaactacagatgtaatgacatatatacattctatgagttctagtatattggaacagtggaattttggtcttacaccaccgccttcaggtactttagaagaaacatatagatatgttacttcacaggccattacatgtcagcgtccgcaacctcctaaggaaacagaggacccatatggtaaaatgacattttgggaggtagaccttaaagaaaaattttctgcagaattagatcagtttgccttaggtagaaagtttttattacaactaggtatgcgtgcccgtcctaggttacaggcctctaaacggtctgcaccttcatcatctagtacagcacctaagaaaaaacgtgcaaaacgtatttaattaaatgtatgtgtgttgtgtttgtgtatgtgtattgtgtgtttgtatatgtttgtgtatgtgtattgtgtgtttgtatatgttatgtaatgtatgtattattgtattgttgtatgtggtgtggtattgtatggcatatggtgttgtacatgtgtgtgtatgtatgtatgtatgtgttttatgttcaataaactatatatgttgtgtgagtggtttttaatagccactgtgtctccattttgttcattcgccattttatatattttaaagttattctgcgaccgctttcggttgcctatactataacatgttttggtctgtttgtgctgttttagcacaaaggtttaatgtgttttggcttcctgcaggcaacttggattgtactcaagcacttaggattaacatgcttcctgcttatgtttcatcctacgcaaggtcatacacgtttaaggcgccacctggcagttactcatgtgtctgcaattgttactacaatgttttgcacacacattttttacccaccctctcataaaattgcttttaatcacatacttgtactatgtaaacagtgtaccttggcagaacattgtattttacatgccaggtaattgttgaaaactgactaagcagtgcttactcattttgcacctggactgttaaaccgttttggatcacacagtgtaccaacccttttataattataaaaa

SEQ ID NO: 29 - DNA, 7909 bp, Human papillomavirus type 40
ttaataacaattgtactgttagtaaagggtgtaaccgaaaacggtccgaccgaaagcggtacatataaattccaacccaaaaaacctgctttggggccagtatgtctgcacggtgcggctcccaggccaggaccctgtatgaactgtgtgaccagtgcaatattacattgcctacgttgcaaattgattgtgtgttttgcaagacggtcctaaaaacagctgaggtactggcctttgcctttagagagttatatgttgtgtggcgcgacgactttccacacgccgcatgtccacggtgcctggacctgcacggaaaagtaaaccaatacagaaactttagatacgcagcctatgcaccaaccgtggaagaagagacaggattaaccattttacaagtaaggattagatgctgcaagtgccacaagcctttgtctcccgtggaaaaaaccaaccatattgtaaagaagacgcaattctttaaattaaaagattcgtggacagggtactgtctacattgctggaagaaatgcatggagaaaggccaacgctcggagacattgtgttaaacctgcaccctgaacctgtatgtctaaactgcaacgagcaattagacagctcagactcagaagatgaccatgaacaggaccaactagacagcttacacagtagagagcgtgagcaacccacgcaacaggacctgcaagtaaatttgcaatcatttaaagtagtaactcggtgtgtattttgtcagtgtttggtgcgcttagcagtgcattgttccatcactgatataacacagttccagcagttgctgatgggcacattacatatagtgtgccccaactgtgcagctacagagtgacaacaatggcagactctccaggtacagaggacgggggggctgggtgctcaggatggtttgtagtagaagctgtagtggataaacaaacgggggatgctgtatcggaagatgaggatgaggaggacatagaggatagtggatttgatatgatagattttattgataatagtgttgtggcagaggaacatgtagaactaagtaatgcacaggcacttttacatgtacagcagacatgtgcagatgctgctgacctgtgcgagttaaaacgaaagtacattagcccatatgtaagtcctatacaatactcagaaccgtctatagacggggacctaagtccaaggctgcatgcaatacggcttggcggcggccaaaaggctaaacggcggttgttccagcgtgtggagcaaagggacagtggctatggctattctgaagtggaaacaacagagagacaggtagagacagaacatggcggaccggaagataccgtggggggtagtgggagggtgaccacagatgaggcggaagcagtagaggttgtggaagacggcagtcatgttatagaccactgtagtccgcgcacacaactaatagagctgtttaaatgcaaggacctaaatgctaagctgtatggtaagtttaaagagctttatggagtggggtttggagacctggtaagacagtttaaaagtgataaatccacgtgtaccgattgggtgtatgctgtgttcggggttaatcccaccatagccgagggctttcatacactgctgaaaaggcaggcattatatttacatacccaatggacgtcatgcaaatggggtatggtgttgcttgcattgtgtagatataaggtgggtaaaaatagggaaacagttgttagacagctatccaaaatgttaaatgtacctgacaaccagatactggtacaaccgcctaaattacaaagtccgcctgcagcattattttggtttagagcaggaatgggtaatgggagcgaggtgtccggcacaacaccggaatggatagctaaacaaactatgttagaacacagctttgctgacacacagtttagcctaacagacatggtgcagtgggcatatgataacgggcatacagatgagtgtgaaatagcatactattatgcacaaagagcagacgtggatgcaaatgcagcagcattcctaaaaagtaacaatcaggccaaatacgttagggattgtgcatccatgtgcaaacactataggttagcagaaatgaggcgcatgtcaatggctgagtggataaagcatagaggggagaagtgtgatgaaggcgactggaaacctatagttaaattattacgctatcaacatatagatataatagtttttttagctgcattaaaaaaatggctacagggtatacctaaaaaaaattgcatttgtattgtgggtcctccagacacaggaaagtcatgttttggaatgagcctgatgcactttatgcaaggtacaataatatcatatgttaattcctgtagccatttttggttgcaatcattggcagatgcaaaggtagctatgctagatgatgttacagcggcatgctgggggtatatggatacacacatgaggaacttattagatggtaacccaaccagcatagatagaaaacataaaccgttagcagtaattaagtgccctccgttactgttaacgtccaatataaatataacacaggacagtaagtaccaatatttacaaagtagggttcaagtgtttgaatttccaaatccatttccatttgacagcaacggcaatgctgtgtatgaattaaatgatgcaaattggaactccttttttaaaaggttggcatccagtttagagctgcaaacacctggggacgaggatggagaatctagccaggcgcctagatttgtgccaggaacagttgttagaactgtatgaacaaaacagcaaagagctacagcaacatatattgcactggaaatatatacgttatgaaagtgcaatatattatacagcaagacaaatgggcattaaacatttaggccaccaggtggtgccaagtttagatgtttcaaaggctaaagcccatgcagcaattgaaatgcaaatgtgtttagaatctttgcaaaacactgaatataatgtagagccatggacgctgcaggacacaagtcaagaattatggcttgcagaacctaagaaatgttttaaaaaaggtggcaaaacagtggaagttagatttgactgcaatgaaacaaatgcaatgcattatacactgtggaccacagtatatgtacaggtggatgatgcatggacaaaggtaaaaggccaggtggactacaaaggcctctcatatacagtgcacgggtgcacaacatattatgtagactttgcaaaggaagcacaaacgtatgggaaaacaaataggtggactgttattgtgggttcacacgttatatgttctcctagtactatcgaggaacacggactacccattgttgagactgctgacgccagacccccgaccactgccaccgacacccccgacgcccccgccacagcgaccaccgaaacggtcggccccgcccaggcaccgcccagaaagcgacgaagaaacggacacctgcccatcaccactactgtgggcaaatcactcggaggagagtacgtggacactgcagacagaacacgcacgcctgaccctgaaagcaacaacgggcacaggaactgtggtggaggttcttctacacctataatacaattagaaggtgaagccaattgcttaaagtgttttagatatagactaggaaaagtgtcacatttattttgtaattcctcaactacatggaggtggaccactgaatccagaaccgagaaaaatgctataataacgttaacatatagtagtgtacagcaacggtctgacttcttagctattgtaaaaataccaaaaacaataaaacatagcttgggtatgttaacactgatgtaatatatgtatatatgtatatatatggaacaccatctgtgaagggtattgtctagcacgtaccacacaaccagccaatctgctgctattattgttaatagagtctacgcttggcatactagtagtctatattgtttttttacttattgcactgttgatctgtgtgtgtgtccctaatctgtatgtgtggagctctatactgtctgctatctccattttgtgctttgtaacatggggtgcactaacatctattactaacctgtttatcctaatactcttagtgtggtatttgcctgcggtggtccttcacacatttattatatatcacatacagaaccaattgtaacatgttgacctgtcaattggatgatggtgatacctggatggcattatggatgttacttgcgtttataactgtgttgttactgttattggtgtttcattgtagaaccttatatttatataggtataccaagtaatactttgtgtagtaaataaacatttttttatattacagcgtcttgtaatggtgtccagcaggccccgtaggcgcaagcgggcgtcagctactcagttatatcaaacatgcaaggcggcgggcacctgtccacctgatgttgttcataaggtggagcaaacaaccgttgcagatcaaattttaaaatgggggagcatgggagtattttttggcgggcttggcataggttccggctctggcacagggggcagggctggctatgtgcctttgtctacaggttcccgggctgtccctcctaaatctttggtacctgacgttgttgctaggccacctgtggttgtggatactgttgcaccctccgatccgtccattgtatctttaattgaggaaagtagtattattcagtcaggtgccccgtcccttactattccaacagagggtgggttttcagtaacgtcctccggtacagatgtgcctgccattttagatgtgtcgtccacaaataccgtgcatgtgacagccaccacacatcacaatcctgtctttactgatccctcggttgtgcagcccatcccacctgtggaggccggtggtcgcctcatagtgtcgcattccactattactactagtgctgctgaggaaatacctttggacacgtttgttgtccatagtgatccattgtccagtacacccgttcctggtacgtctggacggcccaggttgggactgtacagtaaggccttgcagcaggtggaaattgtggaccctgcctttctgtctacccctcagcgtttaattacatatgacaatccagtgtttgagaacgtggatgatacattgcagtttgagcagccatccatacatgacgctccggaccctgcgtttatggacatcattaccttgcacaggcctgcattaacgtctcggcggggtgtcatacgctttagcagggtgggtcaacggggcaccatgtacacacggcgagggacccgcattgggggtcgtgtacacttttttagggacattagtcctattggtgcagctgatgatattgaattgcaccctctagtggcctcggcaccacatacactggagacaccacatacactagagacaccactggacactactgatgccctgtttgatgtgtatgcagacatggatactatagatgatgatgcagcatatgctacattctcattacatcctgccgattctactcgtatatctaacacatccatacctcttgccacggtttctgacacattattaacatctggtcctgacatagtgtttccttctattcctgcaggtacaccatatttgcctgtgtcaccttctatacctgccatatctgtactaattcacggtacagattattatttgcatcctgcatactatttaagaaaacgccgaaagcgcatattagcacatcagtatgtggcaacttaatgaaaatcaagtatatttaccaccgccaacgcctgttgctaccattgttagcacagatgagtatgtgcaacgcaccagtttatattatcatgctggtagtgccaggttactgactataggacatccatactttgagttaaaaaaacccaatggtgacatttcagtgcctaaggtttctggacatcaatacagggtatttagggtacgtttgcctgacccgaataagtttggtttatctgacacctccttgtttaattctgaaacgcagcgccttgtgtgggcatgtgtgggtgtggaggtcggccgtggccagcccctaggggttggtgttagtggccatccatactttaataaggatgaggatgtggaaaactcatctgcctatggcacaggtccggggcaggatagtagggaaaatgtagctatggattataaacagacacagttatgtatgttgggctgcacacccccaattggggaatattggggtaagggcactccgtgcaatgcttctcgggtaacccttggggactgtcctgtattagaattaaaaactgaggttattcaggatggcgacatggtggatactggctttggtgctatggattttgcttccttgcaggccaataaaagtgatgtgccattggatttatgcacatctattagtaaatatccagattatttgggaatggctgcagaaccgtatggaaatagtttatttttttttctacgcagggaacaaatgtttgttaggcacttttttaatagggcaggtactactggtgatagtgtcccaactgacttatatataacaggtacatctggtcggactcctattgcaggcagtatttattactccacaccaagtggatccttggttacctctgattctcagatatttaacaagccattgtggatacaaaaggcccagggccataacaatggcatatgttttggcaatcagttatttgttacagttgtagacaccactcgtagcactaatttaaccttatgtgctgccacacagtcccccacaccaaccccatataataacagtaatttcaaggaatatttgcgtcatggggaggagtttgatttgcagtttatttttcagttatgtgtaattaccttaaatgcagaggttatgacatatattcatgcaatggatcctacgttgttggaggattggaactttaaaattgctcctccagcctctgcatccttagaggatacatataggttccttaccaacaaggctattgcctgtcagcgcgatgcgccccccaaggtacgggaggatccatataaaaaatataaattttgggatgtcaatttaacagaaagattttcttcccaattagatcaatttccattaggacgtaagttccttatgcaggctggtgtacgtgcagggcctaggtttaaatccaggaagcgccctgccccttcctcgtcttcctcttctaagccagtcacccccaaacgtaaaaaaacaaagcgatgagtatggctgcatatgtgtattctggggaatacacccttgcactcccgtatgtgttggtactttggaatgtatgtatgtattgtttgtgtatgttttgtgtttgttgtgtatgtgtccgtatggtactgtgtatgtattgtttgtatgctgtatacctacgttgtggttgtgtgtttaataaagctatatgtgtggtgtggtgtggtatggcagtgtcatggcgtcttgttcagtgttgaccatgtactttttgtgtctaaatcctccattttgtactgcgcgaccgctttcggtcgcggttggcacacacatacatttgtcagcaaatttttattgcatgttacacattgttaggtcaacatgccctgccaaaaatgtagtattagggtgaggtttggcacacctttgattgcacttttcctgtactgttactcatcttattgtatgcacttccaaacatgcttttaggcacatagttttgcctaataaaaagttagctaatagcagttttggcaaaacataacacttgtggttaacatagtacatattactcatggtgcacacctgcggaccgctttcggttgctacatgttttattactttctacttatta

SEQ ID NO: 30 - DNA, 7917 bp, Human papillomavirus type 42
cttattataaactacaatcctggctttgaaaaataagggagtaaccgaattcggttcaaccgaaaccggtacatatataaaccacccaaagtagtggtcccagttaaggcagaatgtcaggtacatctgcctcatcacagccacgcacattataccaattgtgtaaggaatttgggctgacattgcggaatttacagatttcctgcatttggtgcaaaaagcacttaacaggcgcagaggtgctcgcgtaccattttaaagatttggtagtggtgtggaggaaggactttccatatgctgcatgtgcattttgtttagaatttaattctaaaatttgtgcactgcgacactacgaaagatcagcattttggtatacagtggagaaagaaactggactacttttagaagaacaacaaattagatgtgccttgtgtcaaaagccgttatcacagagcgaaaaaaaccatcatattgatacaggtacaagatttcaatttatattgtgtcagtggacgggtcggtgtacgcattgcagaggacaatgcgtggagagacgcctaccctaaaggacattgttttgtttgacataccaacgtgtgagacacccattgacctgtattgctatgaacaattggacagctcagatgaagatgaccaagccaaacaggacatacagcgttacagaatactgtgtgtgtgtacacagtgttacaagtctgttaaactcgttgtgcagtgtacagaggcggacataagaaacctgcaacagatgcttttgggcacactggatattgtgtgtcctttgtgtgcccgcgtggagtaactgcaatggcggatgatacaggtacagaggaggggctagggtgttctggatggttttgtgtagaagctatagtagacaaaacaacagaaaatgctatttcagatgacgaggacgaaaatgtagacgatagtgggttagatcttgtggattttgtagataatagtacagtaatacatacaaagcaggtacatgcacaagccttattaaataaacaacaagcacatgcagatcaggaggcagtacaggcactaaaacgaaagctattaggcagtccatatgaaagccctgtcagtgattcacagcacagcatagacaacgaactaagtcctaggcttggcggtttaacgctatgtcgggggtcccaaggggccaaacgacgattattccagtcactggaaaatcgagacagtggatatggctattctgaagtggaagtacagcagacacaggtagaacacggacatggcgccgtacatgggactatgggtaacgggggggcagtgggtagtgaacttggggtgcaggaaaatgaagaaggtagtactacaagtacgcctacaacaagggtggtagaattacttaagtgtaagaacctgcatgcaacattgttaggtaagtttaaagaattgtttggagtgtcatttggcgatttagtaagacagtttaaaagtgacaaaagcagttgtacagactgggttattgcagcatttggggttaatcatagtattgcagaagggtttaatacattaattaaagcagattcactatatacacatatacaatggctaacctgtacgtggggcatggtgttattaatgctaattagatttaaatgtggaaaaaatcgtactacagtgtccaaaggccttagtaaattattaaacatacctacaaatcaattattaatagagccacctcggttacaaagtgtggctgccgccatatactggtttagatcaggaatatctaatgctagcattgtaaccggagacacaccagagtggattcaaagacaaacaattttagaacattgttttgcagatgcccaatttaatttaacagaaatggtgcaatgggcatatgataatgatattactgaagacagtgacattgcatatgaatatgcacaacgggcagacagggatagcaatgctgctgcatttttaaaaagtaactgccaggcaaaatatgtaaaagattgtggcgtcatgtgcagacattataaaaaagcacaaatgagacgtatgtctatgggtgcatggataaaacatagaagtgccaagataggggatagtggagattggaaacctatagtaaaatttattagatatcaacaaattgattttttagcatttatgtctgcatttaaaaagtttttacataatatacctaaaaaaagttgtttagtgttaattggtcctccaaatacaggaaaatcacagtttggaatgagtttaataaacttcttagcaggaactgtaatatcatttgtaaattcacatagccatttttggctgcagccattggacagtgcaaaaatagctatgctggatgatgcaactccaccatgttggacatatttagatatatatttaagaaatttattagatggcaatccatgcagtatagatagaaaacataaagcattaacagttgttaagtgcccaccattacttataacatcaaatacagatattagaacaaatgacaaatggaaatacctatacagcagagttagtttatttgaatttccaaatccatttccattagatacaaatggaaatcctgtatatgaattaaatgacaaaaattggaaatcattttttcaaaggttgtggtccagcttagaatttcaagaatcagaggacgaggaagactatggagagactggccaaacgtttagatgcgtgccaggaacagttgttagaactgtatgaggaaaatagtagggatttacaaaaacatattgaacattggaaatgtttacgtatggaggcagtggtattgtataaggcccgtgaaatgggctttgcaaatataggacatcaaatagtaccaacattggaaacatgtagagccaaggcccacatggcaattgaaatacacttggcattagagacattattgcagtcctcgtatggtaaagaaccatggacattgcaagaaacaagtaatgaactgtggcttacgaatcctaaaaaatgttttaaaaaacaaggacgtaccgtggaggttatatttgatggaaaacaggacaatgcaatgcattatacagcatggacatatatatatatacaaactgtgcaaggtacatggtgtaaagtacaaggacacgtttgccatgcaggactatattatattgtggaaaatatgaaacagttttattgtaattttaaagaggaggcaaaaaaatatggggtaacagaccaatgggaggtacatgatggcaatcaggtgattgtttctcctgcacccatatctagcaccacatccaccgacgcagagataccctctactggatctactaagttggtacaacaagtgtgcaccacaaacccattgcacaccacaacgtccattgacaaccaccacgcagactgtacagacggaacagcatacaacgtgcccatccaaacctcaccgccacgaaaacgatacagacagtgtggacagtcgccatcacagcacctgcagcactcaaaccccagcatccccagcatccccagcgcatccgtggaccctggattgtgtggggtcagaactaacagtgaaaactgtaacaagcgacggaaccactgtggaagtcaggctacgcctgtaattcatttacaaggtgaccctaattgcctaaaatgcctacgatttaggctaaaaagaaattgttcacatttatttacacaggtgtcatctacatggcatttaacagaaaatgattgtacacgtgacactaaaactggtataataacaatacattattatgatgaagcacaaagaaatttatttttaaatactgtaaaaataccttctgggataaaatcctgtattggatatatgtctatgttacagtttatatgattagttgtatatgtgtataaacagttataggacttcaatactgtgactccacaacgtgtgggacaaccggccagaaactgctgcttttattgtttatagttgttggtgcgtgtgttgtgtgtgtgtggattagtttacaaaattatccatatcctgtatgggcctcttgccttgctagctacctaacattggtgctattatcatggttgcaggtactaacatactttgactatttttttctatgtttaatcattcttggtattccttctgtcttactaacattactaatacatttagcaatacaataacacatattagtttaggtgtgtgtgtgtggtgtgcatgtgatttgtacatggttgtacatatataataccaattattgtttggctactattttcatttatagccacactgctgttttgcatattggtattacaaacatataaactgttaccatacgtatatacagtgctgtaaataaacttttgttatattgtgtgtacttcttttgtgctattacaatgccaccacaacggtcccgcagacgaaagcgggcctctgccacacaattatatcaaacgtgtaaggcctcagggacatgtcctccagatgttattcccaaagttgaaggaaccacattggcagataaaattttacaatggggtagtttaggcgtgttttttggggggttgggaattggcactggtgcaggtacgggtgggcgcacgggctatgtgcctctgggaacaaggcctcctgtaattgctgaaccaggacctgcagtacgcccaccaatagctgttgacaccgtggggccatctgatccttctattgtttccttattagaagagtcatcagttattgatgcaggaataacagtacctgatattacttctcatggaggttttaatattactacatctactggtgggcctgcctcaacgcctgctatattagatatctcccctcccactaatactatacgtgtcacaacaactacatctaccaatcctttatatattgatccttttacattgcagccgccattgccagcagaggttaatgggcgcctattaatatctactcctaccatcacaccccactcatatgaagaaataccaatggacacgtttgttgtatctacagatacaactaacacatttactagtactcccattcctggccctcggtcgtctgcacgcctggggttatattctagagcaacgcaacaacgtccagttactaccagtgcatttttaacatctcctgcacggttggttacttatgacaatccagcctatgaaggacttacggaggatacattagtatttgaacatccatccattcatactgcacctgaccctgatttcatggatatagttgcattgcatcgtcctatgttatcatccaaacagggtagtgtacgtgttagtagaattggacaaaggctgtctatgcagacacgtcgcgggacccgttttgggtcacgtgtacacttttttcatgaccttagccctattacacactcttcagaaactattgaattacagcctttatctgcttcttcagtatctgcagcctccaatattaatgatgggttatttgatatttatgttgatactagtgatgtaaatgttacaaataccacttcctctatacctatgcatggttttgctaccccccgtttgtccactacatctttccctacattacctagcatgtctacacattctgccaataccaccatacctttttcgtttcctgccactgtgcatgtgggccctgatttatctgttgtggaccacccatgggacagtaccccaacgtctgtaatgcctcagggtaactttgtaatggtatcaggatgggattttatattgcatcctagttatttttggcgtaggcgccgtaaacctgtaccatatttttttgcagatgtccgtgtggcggcctagtgacaacaaggtttatctacctcctcctcctgtttccaaggtggtcagcactgatgaatatgtgcaacgcaccaactacttttaccatgccagcagttctaggctattggttgttggtcacccttattactctattacaaaaaggccaaataagacatctatccccaaagtgtctggtttacagtacagagtatttagagttaggctccctgatcctaataagtttacattgcctgaaactaatttatataacccagagacacagcgcatggtgtgggcctgtgtggggctagaagtaggtcgtggacagcctttgggcgttggtattagtggccatccattattgaataagttggatgatactgaaaatgcgcctacatatggtggaggccctggtacagacaatagggaaaatgtttctatggattataaacaaacacagttgtgtttagttggctgtaaacctgccataggggagcactggggtaaaggtactgcctgtacaccacagtccaatggtgactgcccaccattagaattaaaaaatagttttattcaggatggggatatggtggatgtagggtttggggcactagattttggtgctttacaatcctccaaagctgaggtacctttggatattgtaaattcaattactaaatatcctgattacttaaaaatgtctgctgaggcctatggtgacagtatgtttttctttttaaggcgagaacaaatgtttgttcgtcatttgtttaatagggctggcgcaattggtgaacctgtacctgatgaactgtataccaaggctgctaataatgcatctggcagacataatttaggtagtagtatttattatcctacccctagtggttctatggtaacatctgatgcacaactatttaataaaccatattggttacaacaagcacaaggacacaataatggtatatgttggggaaatcagctatttttaactgtggttgatactacccgtagtactaacatgactttgtgtgccactgcaacatctggtgatacatatacagctgctaattttaaggaatatttaagacatgctgaagaatatgatgtgcaatttatatttcaattgtgtaaaataacattaactgttgaagttatgtcatatatacacaatatgaatcctaacatattagaggagtggaatgttggtgttgcaccaccaccttcaggaactttagaagatagttataggtatgtacaatcagaagctattcgctgtcaggctaaggtaacaacgccagaaaaaaaggatccttattcagacttttggttttgggaggtaaatttatctgaaaagttttctactgatttagatcaatttcctttaggtagaaagtttttactgcaggccgggttgcgtgcaaggcctaaactgtctgtaggtaaacgaaaggcgtctacagctaaatctgtttcttcagctaaacgtaagaaaacacacaaatagatgtatgtagtaatgttatgatacatatttatgttatttatttgtgtactgtgttaataaactactttttatatgttgtgtgttctccattttgttttttgtactccattttgtttctagaccgatttcggttgtatctggcctgttaccaggtgcattggccatgtttcctaacattttgcaaacctattcactttttaaatttataaatgcaatatgtgctgccaactgttttatggcacgtatgttctgccaacgtacactccctaattcctttacataacacacacgcctttgcacaggcatgtgcacaaaggttggcaaaggttagcatatctctgcagttacccatttcctttttccttttttttatgtatgagtaacttaattgttatatgtaataaaaaagcttttaggcacatattttcagtgttggcatacacatttacaagttaccttggcttaaacaagtaaagttatttgtcactgttgacacattactcatatatataatttgtttttaacatgcaggtggcaaccgaaaccggtacataaatccttcttattctttt

SEQ ID NO: 31 - DNA, 7975 bp, Human papillomavirus type 43
ctaacaattattatacttgtagtttaaggtgggaccgaaaacggtccgaccgaaagcggtacatatataaaccacccaaaaaccatagcttgtggggcataatgactgcacgtagctgctcccaaaacgcacggactatatttgagttgtgtgatgagtgtaacataactttgcctactctgcaaattgggtgcatattttgcaagaagtggttacttaccacggaagtattatcgtttgcatttagagatttaaaggttgtgtggcgcgacggatatccgtttgctgcatgcttggcctgtctacagtttcatggaaaaataagtcaatataggcactttgactacgcagcatatgcagatactgtagaagaagaaactaagcaaacagtgtttgatttgtgcattagatgctgtaagtgccacaagccattatcaccagtggaaaaagtacagcatattgtgcaaaaggcacaattctttaaaatacatagcgtgtggaaaggatactgcctacattgctggaaatcatgcatggaaaaaagccgacgatcagagactatgtgctaactatgcaaccagaacctagaagcttaacctgtaacgagcaattagacagctcagactcagaggatgagcgtgagcaacccacgcaacaggaccagcaagtgaatctacaagtttacagagttgtaacagagtgcacatcctgtctgtgtgtaattcgacttgttgtgcagtgctctgacagtgacatcaagaagctagaagacctgctgttgggcacattaaaaattgtgtgcccactgtgtaccaccacagcggtgtgactaccatggctgataaacaaggtacagaggatgaggggttgggatgctcaggctggtttatagtagaggcaacagtggacaaaacaacagaaaacaatatatcggaagatgagattgaggacgaggaagaggaagatagtgggtttgatatggtagattttattaataatacattagaagacagttgtacagaccacagcagtgcgcaggctctgttaaatgcacaacaagcggatgctgatgctgctatagtgcaggagttaaaacgaaagtacatgagtccctatgtaagtcctatacactgtttacaggaatctgtagacagagatctaagtcccaggttgcatgcaataaagattggaggcggacaaaaagcaaaaaggagactgtttcacgtaacagagcagcgggatagtaccaatggcaatactgaagtggaagcaagagagacacaggtagaggtggaatatggcggaccggaacgccatatgggggccaataaagggtgtgggagggggagtagtagtgtggcggaagctgtagaggttgtagaggaagcgggtgcaacaaacagtagccaagacataggagagccaagcccacgcacgcgtataatagaattgtttaaagacaaggatgttactgtaaaactgttaggtaagtttaaagaattatttggtgtggggtttaatgatttagtaagacaatttaggagtgacaaatcaacatgtaccgactgggtatatagtgtatttggtgttaatccatccatatcagaaggatttcacatgttattaaaagagcataccctatacctacatacccagtgggtgacctgtagatggggaatggtattgcttgcattatgtagatataaggttgcaaaaaatagaagtacaatagtaagacagctagcacaaatgttaaatgtgcctgtacaacaaattttaattcaaccaccaaaattacaaagtgcacctgcagcactattttggtttaggtctagtatgggaaatggtagtgaggtaacaggcacaacaccagaatggataagcagacaaaccatgctggaacatagttttgcagatacacagtttagtttaactgatatggtgcaatgggcatatgataacggatatacagaggaatatgatatagcatattattatgcacaaagaggtgatatagatgcaaatgcagctgcatttttaaaaagtaacatgcaagctagatatgttagggattgtgcatgcatgtgcaaacattacaagttagcagaaatgaaaaaaatgtcaatggcggagtggattaaacatagaggggggaagtgtaatgatggagactggaaacctatagtaaaatttttaaaatatcaacatatagacattatagcatttctaggtgctttaaaaaaatggttacatggtataccaaaaaagaattgcatttgcataataggtccgccggacacaggcaaatcatgctttggaatgagtttaatgaaatttttaggcggtaccatattatcatatgtaaatgcaagcagccatttttggttacagccattagtggatgcaaaagtggccatgttagatgatgttacagcaggctgttggacatacatggatatgcatatgagaaacctattagatggaaatcctacaagtattgatagaaagcatagagcactcacagtaataaagtgtcctccattattgctaacatccaatttggatattagtacagaagacaagtataaatatttaagaagtagaattacaacatttacatttcctaatacatttccatttgatactaatggcaatgccatttatgagttaaatgatgaaaattggaactccttttttaaaaggttggcatcaagcttagaactggacactgcagaggacgaaaatggagacactagccaggcgactagatatgtgccaggaacagttgttagaactgtatgaaaaagacagcaaaactctggaggaccatgtgttgcattggaaatatatacgttatgagtgtgcattatattataaagcaagagaggcgggcattaaacatctaggccaccaggtggtgccacagctagaagtatcaagacaaaaagcatatttggctattgaattacaaatgtcattagaagcattattacaaactgaatatagcctagaaccgtggacactacaggacaccagtcaagaagtgtggcttacagaaccacaaaaatgctttaaaaaaagaggacagacagtagaagtcagatatgactgcaatcctgcaaatgcaatgcattacaccctatggtcagacatatatgtacctttgaatagcacatggctaaaagtttctggccatgtggactatgaaggcctatcatacacagtatgtgggcaaaagcactattatgtagaatttcataaagaggcacgaacgtatggggaaactggacaatggaacgttgttatgggctcaaacgtcatatattctcctgcatctgtatctagtaccgtcagtgaagtatcctctgttgcgtctactgaatctgacaccggaccagcgaccaccgtcccagattccacgtgcacccaaaaagcagactgccaggagcaagcgccgcctagaaagcgagtgcgattcgacccccacactaccccgatcgccgacttggccagaactgttggaagagggtcagtggacagttcagactcgcgactcgtgcctaagcatacggaccaccaccctagagggcacaaccgtggaagtcacactacgcctataatacagttacaaggtgaagcaaatgcactgaaatgttttagatacagattgaataaacataaacatttgtttgctgatgtgtcatccacatggcgatggacaaccgagtgtaataataaaactaatactgcattaattacattaacatatattagtgaacaacagagggctgactttttgtctcgtgttaaaatacctataactattaaacagtgcctgggagcattaacaatgatgtaaatcatgtatgtatgtatgtatatttgtatagaggaactgtaactgtgataaaagggggggtattgtaccccaaccacacaaccagccaacctgctgctattattgtttatagatgacaagcttggcatattaacacttaacatttttatttgcattcttgctgtattggtgtgcgcatgggtaacggacaacgtggtgtgggcttctgtgcttgcatgtgcttctatcttttattttttgtcttggggcgtccttacatcacctattaacgtttttatattggcgttgttagtgtggtatttgccagcccttttattgcattggtatattatatctgctattgcataacagtaaatatgttaacctgtacatttgaagatggtgatacatggatgtttttatggttacttgtaacagttataactgtattaatattggtgttagcgtttcattacagaacacttaagttgcatcagtcctccagcaaataaacaatcctttatataatcacttgtaaacatggtgtctcatacacataaaaggcgcaaacgggcatcagctacacaattatatcaaacatgcaaggctgctggcacatgtccctcggatgtaattaataaggttgagcatactacaatagcagatcagatattaaaatgggcgagcatgggagtgtattttggagggttgggtattggaacaggctcaggaactggaggcagaacaggctatgtccctctaacaacaggtcgtacgggtattgtccctaaggtgactgcagagcctggagtagtgtcacgtcctcctattgttgtagaatctgttgctccaactgatccttctattgtgtccttaattgaggaatcaagcataattcagtccggggctcctattaccaatattccatcacatggtggctttgaggtaacctcctctggatcagaggttcctgcaattttagatgtttccccatctacttcagtgcatattactacatctacacatttaaatcctgcatttactgatcctactattgtacagccaacccccccagttgaggctgggggacgtattataatatctcactccactgttactgctgatagtgctgaacaaattcctatggatacgtttgttatacacagcgatcctaccactagcacacctattccaggcactgccccacgacctcgtttgggcctgtacagtaaggcattgcagcaggtggaaattgttgaccctacatttttgtcctcgccacaacgtttaattacatatgacaatcctgtatttgaggatcctaatgctacattaacatttgaacagcctacagtacatgaagctcctgattctaggtttatggatatagttactttacatagacctgcattaacatcccgacgaggtatagttagatttagtagggtgggtgcgcgcggtactatgtatactcgcagtggtatacgtattgggggtcgtgtacacttttttacagatattagttccatacccacagaggaatcaatagaattgcagcccctaggacgttcccagtcctttcctactgtttctgatactagtgatttatatgatatatatgcagatgagaatctgttaaataatgatattagttttactgacacacacgtgtccctacagaattctactaaggttgttaatacagctgtgccacttgcaactgtacctgatatttatgcacaaacggggcctgacataagctttcctactattcctattcacattccatatattcctgtgtccccatctatttcccctcagtctgtttccatacatggcactgatttttatttgcatccttcattgtggcatttgggcaaacgccgtaaacgcttttcatatttttttacagataactatgtggcggcttaatgacaacaaggtttacctgcctcctccagggcctatagcatctattgtgagcacagatgaatatgtgcaacgcaccaacttattttattatgctggcagttcacgtttgcttgcagtgggtcacccatatttcccccttaaaaattcctctggtaaaataactgtacctaaggtttctggttatcaatacagagtatttagagttaaattgcctgaccctaataaatttggcttttcagaaacaacactggttacatcagacactcagcgtttagtctggggatgcgtaggagttgaaattggtagaggacaacctttaggtgttggaataagtggccatccgtatttaaataagtatgatgacactgaaaacccgtctgggtatggcacatcgccgggacaagataacagagaaaatgtagcaatggattataaacaaacacagctgtgtattgttggctgtacacctcctatgggtgaatattggggtcagggtgtgccttgcaacgcatcaggtgttacccaaggtgattgtcctgtaatagaattaaaaagtgaagttatacaggatggtgacatggtagatacaggatttggtgcaatggattttgcttccctacaggccagtaaaagtgatgtacccttagacctggttaatactaaaagtaaatatcctgattatttgggaatggcagcagagccttatgggaatagtttgtttttttttctacgccgggaacaaatgttccttagacatttttttaataaagctggtaaaactggcgacgttgtgccttccgatatgtatattgctggctctaataccaggtccaaaattgcagatagtatatatttttctacacccagtgggtctttggttacttctgattctcaattgtttaacaaacccttatggatacaaaaggcccagggacataataatggcatttgttttgggaatcagttgtttgttacagtggtagataccactcgtagtacaaacttaacgttatgtgcctctactgaccctactgtgcccagtacatatgacaatgcaaagtttaaggaatacctgcggcatgtggaagaatatgatctgcagtttatatttcaattatgcataataacgctaaacccagaggttatgacatatattcatactatggatcccacattattagaggactggaattttggtgtgtccccacctgcctctgcttctttggaagatacttatcgctttttgtctaacaaggccattgcatgtcaaaaaaatgctcccccaaaagaacgggaggatccctataaaaagtatacattttgggatataaatcttacagaaaagttttctgcacaacttacccagtttcccttagggcgcaaatttgttatgcaggcgggtttgcgtcccaaacctaaattaaaaactgtaaagcgttctgcaccatcctcctctacgtctgcccctgcctctaaacgcaaaaaaactaagcgataacatatgtgtgtgtgttttgtacctgtatgggttgtttttgcttgttgtgtatgtatggtgtgtttgtgttacgtacttgtttgtgtatgtgtgtatatgtgttgtatgtattgttgcaatgacaaatagaaatgtttgtgtgtatatgtgtatgttgtatacattaataaagatgtttgtgtgtggtgtggtttgtggttgcaccctatgagtaactatgtgtggtgttatgtgtttattaccttttccttttcctgtgtttttgagtttactatttgtaactggctttggttttagtaatggttactgttgtgggtatgtaaaatggcgtctgaacgtcttccattttgtttttgcaaccgatttcggtcgcgtttggcacccttattcatggtgtcagcataatttgcaaaggttactgtgcccctgccaaaatatgttggcacactttttatccctttggcgtcaaggtgtggcttcctacgcccacattccacttttactatacaaatgtaccttttcacctctatgttttattacctttttattctttttgacatatatatttgtttttcatagttactaatagcttttttggctcacataaatgaactgcagtcataaaatatgtatgagtaagtgttgtggtaagcacacctgcagaccgaaaccggtccttacacaccttacattctttgtggttatta

SEQ ID NO: 32 - DNA, 7833 bp, Human papillomavirus type 44
ttaataataatctaacctttacaaaaaagaggaggaaccgaattcggttccaaccgaaaacggttatataaaaaccagcccaaaaattaagcaagcggggcataatggaaagtgcaaatgcctccacgtctgcacaaagtatagaccagttgtgcaaggagtgcaacattcctatgcacaatctgcaaattttatgcgtgttttgcagaaaaacgttaagtactgcagaggtttattcattcgcatataaacagttatatgtagtgtaccgaggaaactttccatttgcagcctgtgccatttgtttagaactacaaggtaaggtcaatcaatttaggcattttaactacgcgggatatgcagtaacagtggaagaagaaacaaataagtcaattctggacgtgctgatacgctgctatttgtgccacaaaccattgtgccacgtggaaaaggtgcgccacatattggacaaggcgcgattcattaaattacaagatacctggaagggtcgctgcttccattgttggacatcatgcatggaaactatactaccttaaaggaaattgttttacagctggaacctcctgaccctgtaggcctacattgcaatgagcaattagacagctcagaagatgaggtggatgaactagccacgcaagccacgcaagacgttacacagccttaccaaatagtaaccacctgtggtacatgtagtcggaaggttcggctggttgtgcagtgcacaggaacagacatccatcacctacatacgcttctgctgggttcactggatatattgtgtcctgtgtgtgcgcccaaaacctaacaacgatggctgacaatacaggtacagagggaacgggatgctcaggatggtttctagtagaggctatagtggagaacacaaccgggcaacaaatatcagaggatgaggatgaggcagtggaggatagtgggttggatatggtggactttatagatgacaggcctattacacacaattccatggaagcacaggcattgttaaacgagcaggaggcggatgctcattatgcggctgtgcaggacctaaaacgaaagtatttaggtagtccatatgttagtcctttaagtaatattgagcaggcagtggagtgtgacattagcccacggctggacgctataacattaagtagacaaccaaaaaaagtaaagcgacggctgtttgacagaccagaattaacggacagtggatatggcaatactgaagtggaagctgaaacgcaggtagagagaaatggcgaaccggaagattgtgggggaggtggacaaggaagggacacagagggggtggaacaggtggaaacggaagtgcagacacatagcaacacacaacagcacaccgggaccacgcgggtactagaactattgaaatgtaagaatataagggctacactgcttggtaagtttaaggattgctatgggttatcatatacagatttaattagacaatttaaaagtgacaagacaacatgtggggactgggtaattgcagcctttggggtgcaccatagtgtgtcagaggcgtttcaaaatttaatacagccagtaacaacatatagccacatacaatggcttacaaatgcatggggaatggtcctactggcattagtaaggtttaaggtaaataaaaacagatgtacagtggcacgtatgatggcaacccgtttaaatatacctgaggaccacatgttaattgaacctcctaaaatacaaagcggtgttgcagcgttatattggtttagaagtggtatatccaatgccagtatagtaactggagaaacaccggaatggataacaaggcaaaccattgtagaacatgggcttgcagacaaccaatttaaattagcagacatggttcaatgggcatatgataatgacttttgtgaggaaagtgaaattgcatttgaatatgcacaacgtgcagatatagatgccaatgccagagcattcctaaatagtaattgtcaggcaaaatatgtaaaagactgtgccacaatgtgcaagcactataaaactgcagaaatgaaaaaaatgaatatgaaacagtggataaaatttaggagcagtaaatttgaagacacaggaaattggaaaccaatagtgcaatttttaagacaccaaaacatagaatttattccgtttttaactaaattaaagatgtggctgcatggtacaccaaaaaaaaactgtattgcaatagtgggcccaccagacacaggtaaatcgtgtttttgtatgagtttaattaaattcttaggaggcactgtaattagttatgtaaactccagcagtcacttttggctacagcccttatgcaatgcaaaagtagcattattagatgatgtaacccaatcctgctgggtatatatggatacatatatgagaaacctattagatggaaaccctatgaccattgacagaaaacacaaatcattagcattaataaaatgtccgcctttaatagtaacatcaaacatagacattactaaagaagagaaatacaaatatttatgtagcagggtaacattatttacatttccaaatccattcccctttgacagaaatgggaatgcactatatgacctgtgtgaaacaaactggaaatgtttctttgcaagattatcatcaagtctagatatacaaacatcagaggacgaggacgatggagacaatagccaagcatttagatgtgtgccaggaacagttgttagaactgtatgaagaaaatagtaataaacttacaaaacatatacaacattggaaatgtatacgatatgaatgtgtgttactacacaaagctaagcaaatgggcctgaaccacattggaatgcaagtggtgccagcattagcagtgtcacagacaaagggacaccaggcaattgaaatgcaaatgacattagaaacattactaaactctgactatggtacggaaccatggacattgcaagagacaagtcgggaaatgtggttaacaccacccaaatattgctttaaaaagcagggacaaactgtggaagtaaaatttgactgcaatgcagacaatgcaatggagtatgtatggtggaaagtcatttatgtatttgacacagacaaatgggtaaaagtgacaggacacatagactataaagggttgtattatgtacatggtgggcataaaacctattatacaaattttgaaaaggaggccgaaaaatatgggaactctttacaatgggaggtatgtattggcagcagtatcatatgttctcctgcatctatatctagtactgtgcaagacgtatccattgctgggcctgcttcacactcctcctcctccaccaccaccacccttgcacaggcctcatccacactgcccattggcaccgccgaggactgcgtggacgcgccgccatgtaaacgaccccgaggaccccccacaaacaccaacaacgccagaaacaccgtctgtgtcagaaacagcgactccgtggacagtacaaacaacaacatcctccctaacagttacaacagtaacaaaggacgggacaacaattattgtacagctacgcctgtagttcaattacaaggtgatgctaattgtttaaagtgtttaagatatagattacatgcaaagtataaaacattgtttgtagcagcatcgtccacatggcgctggacatgttcagatacatccagtaatgcactggtaacattaacatatgttgatgaacagcaacgccagcagtttttaaacactgtaaagttaccaccaaaagttacatataaagttggatatatgtctttacaattgttataatgtgtgttgtatatatctaattgtatatattgtacatggaacacatacctatagatgctactataggggcaaccagcacatcattactgccagttgtaattgccctgtttgtatgctttgttagcattgtattaattatttgtatttctgattttatagtgtacacatctatattggtactaaccttactgctatatctgttactttggcttttactaacctctgccctgcaattttatttactaacactgtgtgtctgcttttttcctgcgtggtatatacatttccatattgtacatacacaacaagaataactattacaatgctaacatgtacgtttgatgatggtgatacatggctgttattgtggttgttattaacattaattgttaccattatagcattgttattaatgcatttaaaaactgtacaatgcgttacatgcagtaaataagtatttgtatatttggtgtgtattgtataaatatggcacacagtagggcacgtagacgtaaacgtgcatctgctacccaattatatcaaacatgtaaggctgcaggcacctgtccctctgatattattcctaaggtggaacataacactattgcagatcagatattaaagtggggcagtttgggggttttttttgggggactggggattggtacaggctctggcacaggcggtagaacagggtatatacctttacaatccaccccgcgtcctgacattccctctgtacctaccgcaaggccacctatacttgttgatactgttgcacctggggacccgtccattgtatccttggttgaagaatctgctattataaattcgggggccccggaattggtccctccttcccatgcaggatttgaaatcactacatctgaatctaccacaccagctatattagatgtgtctgtcaccacacatactacctctacaagtgtatttaaaaaccctagctttgctgacccatctgttgtacagtcgcagcctgctgttgaagctggtggccacatacttatctctacctcatctatatcgtcccaccctgtagaagaaatacctttggatacatttatagtatcttcctctgatagtaatcctgcatctagcactcccattccagcatctggtgcacggccgcgtattggcctatacagtaaggctttgcaccaggtacaggtaacggatcctgcctttttgtcctctccccagcgcctaataacatttgataatcctgcatatgaaggggaggatgttactttacactttgcacacaatactatacatgaacctccagatgatgcgtttatggatattatacgattgcacagaccggctatacagtccaggcgtggtcgtgtgcggtttagtagaattggacaacgagggtctatgtacacacgtagtggcaaacatattggtggcaggatacatttctatcaagacatttctcctatatctgctgctgcagaagaaatagaactgcacccccttgtggccactgcacaggatagtggcctgtttgatatttatgcagaacctgaccctgatgttacagaagaacctgtttcattgtctttttctacctccacaccctttcagcggtcttctgtgtcagccaccccatggggcaatactactgtccctctttcattacctgctgacatgtttgtacagcctggtcctgacataatctttcctactgcatccactacaactccctatagtcctgtcactcctgctttacctacaggtcctgtttttataagtggtgctgcattttatttatatcctacatggtattttgcacgcaaacgccgtaaacgtgtttccttgttttttgcagatgtggcggcctagtgaaaaccaggtatatgtgcctcctcccgccccagtatccaaagtaatacctacggatgcctatgtcaaacgcaccaacatatattaccatgctagcagttctagacttcttgctgtgggcaacccttattttgccatacgaccagcaaacaagacacttgtgcctaaggtttcgggatttcaatatagggtttttaagatggtattgccagaccctaataaatttgccttacctgacacatctatatatgaccccactacgcaacgcctggtatgggcctgcatcgggctggaggtaggtagaggacagcccttaggtgttggtattagtgggcatccattattaaataaattggatgatgtagaaaattcagctagttatgcagccggtccgggtcaggataacagggtaaatgtggccatggactataaacaaacacaattatgtttggttggctgtgcacccccgttaggtgagcattggggtaaaggcaagcagtgtaataatgttagtgttaaggatggggactgccctcccttggaattaattactagtgtaattgaggatggtgatatggtggacactggttttggagccatgaattttgctgaattgcagccaaataaatctgatgttccattagatatatgcactgctacatgtaaatatcctgactatttacaaatggctgcagatccatatggggacagattgtttttttacttacgaaaggaacagatgtttgccagacatttttttaatagggctggaacagttggtgaggacgtttcccaggatctggttattaaaagtgctagtaaaaatactgttcctaatgctatatactttaatacacccagtggttctcttgtatcttctgaaacccaattatttaataagcctttttggttgcaaaaggcgcagggccacaataatggtatttgttggggaaatcagttatttgttactgttgtagatactacccgtagtacaaacatgacaatatgtgctgccactacacagtcccctccgtctacatatactagtgaacaatataagcaatacatgcgacatgttgaggagtttgacttacaatttatgtttcaattatgtagtattaccttaacggcggaggtaatggcctatcttcatactatgaatgctggtattttagaacagtggaactttgggttgtcgccgcccccaaatggtaccttagaggacaaatacagatatgtgcagtcccaggccattacatgtcaaaagccaccccctgaaaaggcaaagcaggacccctatgcaaaattaagtttttgggaggtggatcttagagaaaagttttctagtgagttggatcaatatccccttggtagaaaatttttattacaaacgggtgtgcaggcccgttcctctgttcgtgtgggtaggaaacgtcctgcgtctgcagccacttcctccagtaaacaaaaacggtctaggaagaagtagtatgtgttattgttttgtttgtatgtgtgtcatatgttattgtgttatatatgtgttgtgttgtatatatgttgtatgtgtatgttgtgtaatgttgtctgtaatggaatgcatgtgtgtgttgtacataataaacttaatctgtgtgtcctgttccaccccatgagtaagtgttgtagtgttgtgttctatgtttggtatatataatatataacatatgtacagccatgttagtttttaaacatattcctccattttgggtgcaaccgttttcggttgttcattttgggtgcaaccgttttcggttgttactcattacccacatcctgtacccaatttgttatagcaagcaaaatatttaatcatctctgccagaactttattatgttactaagtacacacctggcgcacagctaggcgcggtttggcaactacacaatacattcctaatctctatactactgctgtctcgtttgtgaacaatagtgcgctggtagccaactttttaaaagcatttttggctactagcactgcatttttgtacagttactgttggttttataaaatgagtaacctaaggtcacacacctgcgaccggtatcggttgacacacaccctgtacacttccttatcatag

SEQ ID NO: 33 - DNA, 7856 bp, Human papillomavirus type 53
gaaagtaacaatcctacttttatagacagggagtaaccgaaataggtttaggaccgaaaacggtacatataaaagcactgtgtacaacacccaggacatccatggatcgtcagttatttgaaaatacagaagagcgaccacgtacattgcaccagctatgtgaagttgtgaataaaccattgctggagctgcaacttggctgtgtgttctgcaagaaggcattgacagcgtcagaggtatataattttgcatatacagatctaagagtagtgtatagagacgggtatccgtatggagtgtgcaaattctgtttgctattttatagtaaggtccgaaaattaagatattacaattgttcagtgtacggggctagcctggaagcactaactaaaaaaaagttatctgatttatcaataaggtgctacagatgtcaacatccgttgacaccagaggaaaaacagttacactgtgactataagaaacggtttcacaaaatttcacatatgtggaccgggtcgtgcctgacatgctggagacacacaacagcaactgaatcagcagtataatcatgcacggtaacgtaccaacacttccacaatatattatagaacttataccacaaactgagattgacctgcaatgccatgagcaattgaacagctcagaggatgaggatgaggatgaagtagaccatctgcaggagcagccacagcaagctagacgggacgaacaacatccttgttacctaattgaaacacagtgttgtaggtgtgagtcgttggtgcagttggctgttcagagttcaacaaaagagctgcgtattttacaacaaatgcttatgggcacagtggagcttgtgtgccccctctgcgcaacaaggcgataactgcaatggcgtcacctgaaggtacagatgatgaggggggatgccggggatggtttcacgtggaggcaatagtaaaaaaacgtacaggggatgtaatatctgaagatgaaacagacgaggaaagcaccgaatctgatttggatgggtttatagacaatagtaatataatatctacacaggcagaaagggagacagctcagcagttgttacatgccaaaacacacatgcagatacacagacgctgcagaaattaaaacgaaagtatttaggcagtccattaggtgatattagtaatcagcaaacagtgtgccgggaagctgtaaaacgaaggctaattgatacagaagtgccggacagcgggtatggcaatactttggaaacgtggaagcaacgcaacaggtacaggaacagtatgtaagggaggcaagtggcgggaaagagcaaaatggaggctcacaacatagtgtgtgtagcagagatgggagcatagggtcaggaagtgatatggatgtggatagacaggatataatgccactgcaacaaatacaagatatattaaaatgtagtaatgtgcaggccaagctatattgtaaatttaaagatatatttggcataccattttcagagttggtacgaacatttaaaagtgatagtacatgttgtcatgattggatatgtgctatatttggagtaaatgaacattagcagaggcattaaaaacaattattaaaacacagtgcatatattaccatatgcaatgtttaacatgtacatggggcgtggttatattattgttaattagatatacgtgtggcaaaaacagaaaaacaattgtaaagtctttagcatccatattaaatgtaccaactgaacaaatgcttgtgcagcctccaaaaatacgtagccctgcggttgcattatacttttataaaacatctatatccaacattagtgacgtgtatgggagtacaccagaatggatagaaagacaaacacagttacaacatagctttgaggactgtcaatttgaactatctaaaatggtgcagtgggcatttgacaatgaagtaaccgatgatagtcaaatagcatttcattatgcacagttagcagatgtagacagtaatgcacaagcatttttaaaaagtaatatgcaagcaaaatatgtaaaagactgtggaataatgtgtagacactataaacgggcacaacaacaacagatgaatatgaaacaatggataaagcatgtatgtagcaaggtggatgatggtggggactggaagccaatagtacagttcctaaggtatcaaggggtcgagtttatttcatttttaagttattttaaattatttttacaaggtacaccaaaacataattgtttagttatttatggtcctccaaacacgggtaaatcatgttttgctatgagtcttataaacttttttcatgggtcagtcatttcatatgtaaattcacacagtcacttttggttacaaccgttagacaatactaaattaggtatgctagatgatgccacagaggcatgttggaaatatattgatgaatacctaagaaatttattagatggcaatcctgtaagcttagatagaaaacataagcaactagtacaaataaagtgtccacctgtactaataacaactaatataaatccaatgcaagatgcaaagctacggtatttgcacagtagaatacatgtgttacagtttttaaatccatttccaattgatgtgaatggaaatcctgtataccaattaaataatgcaaactggaaatgtttttttgaaaggacatggtccagattagatttggataacgacgaagacaaggaaaacgatggagacgctatgccaacgtttagatgcgtgccaggagaaaattctagactgttttgaaagagatagcaaaaatattacagaccatatagactactggaaagctgtgcgacaagaaaatgtaatatattataaggcaagagaaaataatatgactaaactaggccaccaggtggtgccctgtttacaagtgtgtaaagcaaaggcatgcgttgctatagaactacaaatagcattggaatcactttgtaaaacagaatataatatggaagagtggacattaagggatgtatgtgaaagtatgtggtatacagaacccaaacagtgttttaaaaaacaaggacaacatatagaagtgtggtttgatggcagcaaggacaatcgggctgaatatgttgtgtggaaatgggtatattattgtggggaggatgggtggtgtaaagtgtcttctgcagtaagctatgagggcatatattatatacatgacggccataaaacgtattatacaaactttaaagacgaggccaccaaatatgggtgtaaaggcacatgggaagtgcatatgggaaaacaaagtatttattgtcccgactctgtgtccagtacctttagatccaacgtatcctctgttgaaactgttaacgaatactactcccataagacccccaccacctccacgcccgtgggcacctacgaagcctcatcatccctgcggccgggaaaacgtcccagaaccacagagcccgacagtactgactccaccacacagtccactaccacagccagagagtcctacgcagagtgtgtcgcaaggaacacagacaacacaaacaacaacaccagaaaacacctccctggtggagcttcgtgtaacaacaccgaaatcgacagtggttataagactgcacctgtagtacatataaaaggtgaagcaaacagactaaagtgtttaaggtatcggtttcaaaaacataaacaactgtttgttactgtatcatccacctatcattggacaaatgtaaactgtgctgtaaataatagttatattactgttgtatataaagatgaaacccaacgccaaaaatttttggatattgtaaaaataccccctagtgtatcactggtactgggacatatgacatgtgttgatatgtaatgttaatgtaattgttacattatgtaatattgtattacaataatacctggtatatacaatactacacacgccatatatgctgctaggcctgtaaacttgcaaccattgtgttgtgtgttagttttgtgtttttgctttgctgctttgtgtgcctgtttgtctgctttaatgtgccgctattgcagtctgcctctgtgtttgcctcgtgtatattacttatacttttattttggtttgttgtggcatcatcctacataaccacatttacactatatatactttttttttacttccctttattatgtttctatagccatgctgtgtggttaattaacacacaataaatcacagtttttttgtattgtatgtatttgtgtgttatatataatggttgcccaccgggcacgcagacgtaagcgggcatcagcaacgcagctatatcaaacatgtaaacaatctggcacatgtcctgaggatgttattaacaaaattgaacacaaaacctgggctgataaaatattgcaatggggtagtttatttacattttttggaggccttggtattggcactggctctggcactggggggcgtacaggatatattcctttgggtactaggccttccactgttgttgatgtaacccctgctcggccccctattgttgtagaatcggtaggccccactgacccttcaattgttacattggttgaagaatccagtgttattgagtctggagcttcgttccctaattttacaggtactgcaggatttgaagtaacatcctcctcaactaccacacctgcagtattagatataacacccacctctacctctgtacatgttagttctactacatatactaatcccacatttgtagaccctcctgttattgaggtcccccaaactggtgaggtatctgggaatatattgataagtaccccaacatctggggttcatagttatgaggaaatacctatgcaaacatttgctgttcagggtacaggcaatgaacctatcagtagtactcctattcctggtcttaggcgtatagctgccccacgtttatataaaaaagcctttcaacaggttaaggtcacagatcctgcatttcttcacaaacctgaaactttaattaatgttgataatcccatatttcaaaatgctgacacaacgttaaccttttcaccatcaggtgtggcacctgatcctgattttttagacattgtggctttacacagacctgcctttacaacacgtagaggtggtgtgcgttttagtaggcttggcacaaaggccactatgcgcaccagaagtggcaaacaaataggtgctcgtgtacattattattatgatgtgagtcctattacacagactgaagaaattgaaatgcagccattattgtctacagataatacatttgatggcctatatgatatttatgcaaacatagatgatgaggcacctgtgtcatctcgtttttctattgctacaccttctaggttgcctaccaacactgttcctttgtcttttagtggtagtacctctaatgttacaataccctttggtacatcttgggatgttcccatctattcaggtcccgatgtagtgttgcccacaggaccccctacatggccttatgcacctcaatctccttttgataccacccatgatgtagttatacagggctccacatttgcgttatggcctgtttattttttgaaacgtaggcgtcgtaaacgtattccctattttcttgcagatggcggtgtggcggcctagtgacagcaaggtttatctgcctcctacccctgtatcaaaggtcattacaacggatgcctatgtaaaacgcaccactatattttatcatgctggaagctctcgcttgcttaccgtgggacatccttattaccccatttctaaatctggtaaagcagacatccctaaggtgtctgcatttcagtatagggtgtttagagtacgcctcccagatcctaataagtttggccttcctgatacaaatatatttaatcctgaccaggagcggcttgtatgggcctgtgtagggctagagattggccgtggacagcctttaggtgttggtgtaagtggccatccactgttcaataggttggatgacactgaaagctctagtatagctattcaggatactgccccggacagtagggataatgtttcagtggatcctaaacaaacacagttatgcattattggctgtgcacccgctataggtgaacactggacaaagggtacggcctgtcgttccacacctactacagcgggcgactgccccccattggaacttatcaattcacctattgaggatggagacatggtggacacaggttttggtgcattaaactttaaagctttgcaggaatctaaatctgatgtgccattggatattgtacaatccacatgtaaatatcccgattatttgaaaatgagtgcagatgcctatggggattctatgtggttttatttacgtagggaacagttgtttaccagacatttttttaatagggcaggcgttattggtgaggaaatacctaatgacttatatattaagggtagtaatggcagggacccgccccctagctctgtatatgttgctacacctagtgggtctatgataacttcagaggctcaattgtttaataagccatattggctgcaacgtgcccagggacataataatggcatctgttggaacaatcagttatttgtaactgttgtggataccaccaggaatacaaacatgactctttccgcaaccacacagtctatgtctacatataattcaaagcaaattaaacagtatgttagacatgcagaggaatatgaattacaatttgtgtttcaactatgtaaaatatccctgtctgctgaggttatggcctatttacatactatgaattctaccttactggaagactggaatataggtttgtcgcctcctgttgccactagcttagaggacaaatacagatatgtgaaaagtgcagctataacctgtcaaaaggatcagccccctcctgaaaagcaggacccactatctaaatataaattttgggaggtcaatttgcaaaacagtttttctgctgatttggatcagtttcctcttggcaggaagtttttaatgcaggttggggtccgtactaaaccgcctgtatcctctaaaaaacgctctgcttctactacatctacctcagccccctcctccaagcgcaaacgcaaatagtatgttgtgtgtctgtattgtgtatgtatggttgtattatgtactatttatttattgtgtatactgtatgtgtgtatttgttgtctgtgttgtatgactgtatgtatgtgtaatgtttgcatgttgttaataaatatgaatgagtgttacttttacgcgtggttgcataaactaaggcgcggtggtgtccctaggcagttgggtggcatgttaggtggcgtccctgtttatataccaatctccaccctgtattattaatatatgtactgttatcatgcagttacctataccacatatagtatagcttataggtatccattttagtttggcgcctttttggtaccctccattttgccttgcaaccggtttcggttgtgcatatcttgtaaataccacaagcatattcagcagaactgttaatcctttggcatagtgccgtttcctgtgtttaatgtttttttgttttatacactatgccttacctattagtcacttactgtaggctgccaactatgcttttacctgcataccttagtgcttttgggcacacatttttattgcaaacatctgcactttagtgttttggcttgcagcatacgttctgctagccaagtatctgtctagtaaaccaggtgtgcacctattactcatgcaccgcaaccgtttacggttttgcagcaacaggccttttttataattatt

SEQ ID NO: 34 - DNA, 7759 bp, Human papillomavirus type 54
taactacaaccatgatttataaaataagggagggaccgaaaacggttcaaccgaaaccggtacatataaaagcggttgtagaaaacagttatttgggggcaatgtctgctactgaaccccacacggaccagccgcgtactctagctgatttgtgcaaggtatgcaatattcctatgcatagtttgcaacttccttgtgccttttgcaagaagacggtgtgtacagcagagatttatgcatttcaatataaggacctatttgtggtgtggagacacggctttccacatgctgcatgtgcactgtgcctagaactgcacgggcaaataaattatagaaggcatcgcgaccgtgcgtgcctgtgggaaacagtggaacaagagtgtggaaagccattggaagaaatatttataaggtgctggctgtgccataaacctttgtgcaacgtggaaaagcaacggcacgtagattacaacaggcgattccactgtgttagaggctattggaagggtaggtgtctacattgctggaagccataatgcatggaaatgtggctacaattgaggatatagtccttgatttaaaaccagaaccgtttgacctgtactgcagggagcaattagaagactctgatgcagaagatgagacagcagtaacacaacctgacaaacaagcatttaaggtgttaagccagtgtggaggtgtgtgttgtaagacagtacggctatgtgtgtatagcacgcacacaggcataagggtactgcaggaactgcttcatcaggacgcactgcaaatagtgtgtcccacctgtgcttcacgactataacggcatggcggataaccaaggtacagaggaggaggggactgggtgtaatggatggttttttgtggaagcaattgtagaacgtaaaacaggggatattatttcagatgatgagcctgaggatgtggaggacagtgggcttgatatggtggactttattgataatagtgtgtcacaggtagaggggcaggaaaatccacaggcattgttacatgcccaacagctgcaggcagatgtagaggcagtgcaacaattaaaacgaaagtatataggcagtccgtatgtaagtcctgttgcaaacagcgaaccctgtgtagaaaaggacctaagcccccggctaggggctatatccctaggacggcggtcagccaaagccaaacgacggctgtttgataaggcccaaccgccgccaaatggccatactgacgtggaagctgcggtggaggtaaataccgaggggacagatgaaacagagacagaccaggtgcagacagtatctggggaaacaactacagatagcctaggaaggcagcaaattacagaattaatacataacacaaatattcgtgtagcattgtttggtatgtttaaagacctatatggattaagttttatggacctagcacggccatttaaaagtgacaaaacagtgtgtaccgattgggttattgcagcatttggaatatatcatggtattacagatggatttaaaacattgctagagccacattgtttgtatggccatatccaatggctaacatgtaggtggggcatggtattattattattaacaagatttaaatgtggcaaaaacagattaacagtaagtaaatgtttaggaatgttattaaatataccagaaacccaaatgttaatagatcctccaaaattacggacgcctgcagcagctttgtattggtatagacaggggctgtccaatgcaagtgaaatatttggtacacccccggaatggctggccagacaaactgtaattgaatatagcttagcagacagccagtttgatttatctaaaatggtacaatgggcatatgaccataattatattgatgacagtattattgccctggaatatgctaaattagctgatatagatgaaaatgcggctgcctttctaggaagtaattgtcaagctaagtatgtaaaagactgtggaacaatgtgtagacattatataagggcacaaaaaatgcaaatgacaatgtcacaatggattaaacatcgttgtgatttagtagaggaggaaggtgagtggaaggaaatagtacgattccttagatatcaacatgtggattttatatcttttatgatagcattaaaacaatttttacaaggcataccaaaacacaattgtatattactgtatggacctccagacacaggaaaatctaattttgccatgagtttaattagctttttaggaggtgtagtgctatcatatgttaattctagtagccatttttggttagaacctttggcagatgccaaaatagctatgctagacgatgctacaacacaatgctggaactatatggacatttatatgcgcaatgcattagatggcaatcctatgtgctttgatagaaaacatcgagctatggtgcaaacaaaatgtcctccactaatagtgacctccaacataaatgctagtacagacgacagatggcgctacctacacagtagagtaaaatgtttttgttttcccaatagatttccatttgatagtaatggaaaccctgtgtatgatttaagtaataaaaattggaaatcattctttaaaaggtcatggtcacgtttagcgctgaacgacaacgataacgaggaggaggagaatggagaccctagcaacacgtttagatgtgtgccaggaaaggcttctagacctatatgaaaaagatagtaataaactagaggaccaaatagaacattggaaatgcatacgcctggagtgtgcattgcaatacaaagcccgggaaatgggatacaaagtgttacagcaccaggcactgcctgcacttgctgtgtcaaagggcaaagggcacaaggccattgaactgcaacttgcattagagacattgcaaaagacagtatacagcaccgaaccgtggacattacaggacacatgcctggaacggtggaatgcaccaccaactggttgcttaaaaagacgtggacaaacagtagatgttatatttgatgggcatcaggataacacaatgcaatatgtaatgtggggagatatttattatcaaaactgtgatggggagggatggactaaggtgtgcagtaatatagatgcaatgggtatttattatatggatgcagaacacaaagtgtattatgtggattttaaaaaggaagcatctaagtatggggaatatggacagtgggaggtgcgtatgggcagcagcatcattttttctcctgcatctgtatctagtaccgaagaggcattgtcaatatcctctactggcactgctgaacacaccagaccagccaattccacaccacgtaccgacaactccacaaaagcaatcccgtgcacgccgccgcctagaaaacgagctagagtctacagcacagaccagcaaccacacagcacctcagaccccgtgggctgtgacaacgacaggcacatcagtgacgataacaacaagaaccaaggacggcacacaagtagtggtgacactacacctatagtgcactttaaaggtgaacctaatacattaaaatgttttaggcaaagaatacaaaagtataaacatttgtttgaacaagcatcctcaacatggcattgggcatgtgtaccaggtaccactaagaataggggcattgtaacattaacctatagtagtgtagaacaaaggcaacaatttttagtaactgttcgcattccacctagtatatctatgtcattaggggtaatgtcattataacagataatcattgtaaagtttgtgattgtacatactatattgtaaaacaaccagccaatactgctgctatgtgtatatagtgaggtatgtatggtgagtatggtagtgagtgcatgcaggcctgcagtgactgaggtgaggtgtgtgtgtaggtgtgtgtagtgtatgcagtaataatgttgtatacagtaagttggttaacatgttggtttttattatccatgttattatggcaatgtattacaacagcatttactttttttcttgtagcctttattctattgtgggtacctgccctgtgtgtttatgtgcgccttgccaggcttcttgaacttgaccttcactttacataaggtgttactgtgcacacctactgtggatgccctgtgtaacctgcttaccatagtataataaatattgtgtagatatatttgtgtattatggctaaagcaagagccccacgccggaaacgtgcatctgcaacacaattatatcaaacatgcaaggcctctggcacatgcccttcagatgtaattcctaaggtagagggtacaactatagcagatcaaatcctacgatggggcagtatgggcgtgttttttgggggcttgggaataggtactggtagtggcacagggggccgcacagggtatataccacttggacgaccctctactacccttgaaccaggtcctcctgtacgtcccgcaggggctgtagaaacagtagcaccctctgacccttccattgtgtctttagtagaggaatctagtgttgtggatgttggggcaccaacccctaccattccatcacagggtgggtttgaaatagccacatctagtgatgctacccctgctatattagatgtcacctccactaccacccctattagggtgtctataacatcccatgataatcctatatatacagagccatcattattagaccccccccctccagtacaaatggatggtcgtgttttagtatctacctctactttgcaatcgtccactgctgaaaatatacctatggacacttttataattatgcaggaccatataggcacaacaactagcacacctataccaaggccgcctgcacgcccacgcttaggtttatattcccgtgcgttacagcaagtgcctgtacaggaccctgcctttttacaacagccttccagtcttataacatatgacaatcctgtatatgagggtaacccagatgttaccctacactttgagcagcccacaatacataatgcacctgatcccgcctttatggacatatttgctttacatagaccagcacttacaactcgtaggggggttgtacgttatagtagggtgggcgacagggccacattacacacacgtagtggcctgcaacttaaacctcgtgtgcatttttttcaggacttaagccctattgctcatgtccctgaggaaatagaattacaccctttaatatctgcaaacaatacaagcattaacaatggtctttactcagatatatatgatgtatatgctgacacagattttgctgacactggtggtttttcctcttctactgtttcacatagttctgtacaaacagccctacaaactacatctataccatctcagtatggtaacaccacagttcccctaactgcctcatcgccatatacacctatacccacatcctttaggccctcatcaggtcacaccccatttgttcccgcacgtcctatatttccacaaacacccattgctgttaatggtggggatttttacctgcatcctagttatacttatgtacgcaaacgccgtaaacgtttcccatattttcttgcagatggctatgtggcggcctagcgaaaacaaagtatacctgcctcctaccccagtttctaaggttgtcagcacggatgaatatgtgactcgcacaagcatatactatcatgcaagcagctctagattattggctgttggacatccatattttaaagtacaaaaaaccaataataagcaaagtattcctaaagtatcaggatatcaatatagggtgtttagggtgcaactacctgatcctaataagtttggactgcctgatcctagtttatataatcctgagacacaacgcttagtatgggcatgcacaggtgtggaggttggtaggggccagccattgggtcttggcctaagtggtcatccattattaaataaattggatgatactgaaaatgcacctaaatatgttggtgcaggagctgacaatagggaaaatgttagcatggactataaacaaacacagttatgtattttgggctgcacaccacctataggtgaacactgggctaaaggcaacctatgtacacctaatacattggctgctggtgactgtcctcctttggaattagtaaattcatatatacaggatggtgatatggtagatataggatttggggctatggattttaaaaccctacaaacctcaaaaagtgaggtaccccttgatgtagctacctcaatttgtaaatatcctgattaccttaaaatggctgcagaggcatatggggacagtttatttttttacttaaggcgggaacaaatgtttgttaggcatatgttaaatagggcaggtaccatgggtgagcctgtacctaatgacttatacattaagaaatcctcaggtaaccttgacagttctatttatgctgcaactcctagtggctctatggtaacatctgaataccaaatatttaataagccatactggttacaacgggcccagggtcaaaacaatggtatttgttggggcaatcaggtgtttttaacagttgtagataccacccgtagtactaacctaacattgtgtgctacagcatccacgcaggatagctttaataattctgactttagggagtatattagacatgtggaggaatatgatttacagtttatatttcagttatgtaccataacccttacagcagatgttatggcctatattcatggaatgaatcccactattctagaggactggaactttggtataacccccccagctacaagtagtttggaggacacatataggtttgtacagtcacaggccattgcatgtcaaaagaataatgcccctgcaaaggaaaaggaggatccttacagtaaatttaatttttggactgttgaccttaaggaacgattttcatctgaccttgaccagtttcccttgggtcgcaagtttttactacaggctggcctacgtgcacgtccgcgccttcggcctgtaaagcgtgcagccccttcctcctctaagggtacagcgcgcaagcgtgctaaaactaaaaggtaacagtgttgtatgttgtgttgttatgtgttgttgtgtttgtaccttgtctgtgtgtatgttgtgtatgtattatgttatgtgtggaatgtttgtgtgtcctatttatgttgtgactcgtatgttatatatgttgtatgttttcctgtattatatataataaagactttggttgcaccctatgagtaacttttgtgtgatgttgtttgctacgtgcttagtagcctttaccttttcacctttggtgtccattttgtataatctccattttatataaccgaaaccgttttcggttgctgttggcactaaaactgtgttttaagcactttgtatcgtacatctaatcttttgggcgccgccacatcctgccctggtagttttgccagcacatctgcacacccacacatttataactgtcagaacaacttcactttccattgtgtaaaaacacgccctttgcattccaacattgatttatatattttttacataataaaacatgctagtaggcacatattttagctgtgtaaacttagtaagtgcatagttggcaaactaaaacataggtgtatgccaggtacgtgtctgtacaacagtgactaattcaggaaaccgatttcggttgctcacccattatcttttttatcattattat

SEQ ID NO: 35 - DNA, 7822 bp, Human papillomavirus type 55
taataataatgtaagctttagaaaagaggagggaccgaattcggttccaaccgaaaacggttatataaaaaccagcccaaaaattaagcaagcggggcataatggaaagtgcaaatgcctccacggctgcacaaagtatagaccagttgtgcaaggagtgcaacattcctatgcaccatttgcaaattttatgcgtgttttgcagaaaaaccttgaccactgcagaggtttattcattcgcatataaacagttatatgtagtgtttcgaggtaactttccatttgcagcctgtgccatttgtttagaactacaaggtaaggtcaatcaatttaggcattttgacttcgcgggatatgcattaacagtggaagaagagacaaagcagtcaattttggacgtgttcatacgctgttatttgtgccacaaaccattgtgccacgtggaaaaggtgcgccacatattggagaaggcgcgatttattaaattacagaatacctggaagggtcgctgcttccattgctggacatcatgcatggaaactatcctaccttgaaggaaattgttttagagctggatcctcctgaccctgtaggcctacattgcaatgagcaattagacagctcagaggatgaggtggatgaactagccacgcaggccacgcaagacgttacacagccttaccaaatagtaaccacctgtggtacatgtaaccggaacgttcggctggttgtgcagtgcacaggaacagacatctgtcaactacatacgcttctgctgggttcactggaaatactgtgtcctgtgtgtgcgcccaaaaactaacaacgatggcagacaatacaggtacagaggggacggggtgctcaggatggttcttagtagaggctatagtggagaaaacaactgggcaacaaatatctgaggatgaggatgaggcagtggacgatagtgggttggatatggtggactttatagatgacaggcctattacacacaattccatggaagcacaggcattgttaaacgagcaggaggcggatgctcattatgcggctgtgcaggacctaaaacgaaagtatttaggtagtccatatgtgagtcctttaagcaatattaaggaggcagtggagtgtgacattagcccacggttggatgccataaaattaagtagacaacccaaaaaggtaaagcggcggctgtttgaaagaccagaattaacggacagtggatatggcaatattgatgtggaagctgaaacgcaggtagagagaaatggcgaaccggaagattgtgggggaggtggacaaggaagggacacagaggagggggtggaacaggtggaaacggaagtgcagacacatagcgacacacagctgcacaccgagaccacgcgggtagtagaactgttaaaatgtaagaatatacgggctacactgcttggtaagtttaaggactgttatgggttatcatatacagatttaattagacaatttaaaagtgacaagacaacatgtggggactgggtgattgcagcatttggggtgcaccatagtgtatcggaggcgtttcaaaatttaatacaaccagtaacaacatatagccacatacaatggcttacaaatgcatggggaatggtattactggcattattacggtttaaggtaaataaaaacagatgtacagtggcacgcatgatggcaacacgtttaaatatacctgaggatcatatgttaattgaacctcctaaaatacaaagcggtgttgcagcattatattggtttagaagtagtatatccaatgccagtatagttactggagaaacgcctgaatggataacaaggcaaaccattgtagaacatgggcttggtgacaaccaattcaaattaacagaaatggtgcaatgggcatatgataatgacttttgtgaggaaagtgaaattgcatttgaatatgcacaacgtgcagatatagatgcaaatgcaagagcatttttaaatagtaattgtcaggcaaaatatgtaaaagattgtgctacaatgtgcaagcactataaaactgcagaaatgaaaaaaatgagtatgaaacagtggataaaatttaggagcagtaaatatgaagaaacaggcaattggaaaccaatagttcaatttttaagatatcaaaatattgaattcattccatttttaactaaattgaaaatgtggctgcatgggacacctaaaaaaaactgtattgcaattgtaggaccaccagacacagggaaatcgtgtttctgtatgagtttaattaaatttttaggaggcactgtaattagttatgtaaactctagtagtcacttttggctacagcccctatgcaatgcaaaagtagcattgttagacgatgtaacacaatcgtgctgggtatatatggatacatacatgagaaacctattagatggaaaccctatgactattgacagaaaacacaaatcattagcattaataaaatgtccgccattaatagtaacatctaacatagacattactaaagaagataaatataaatatttatgtagcagggtaacattatttacatttccaaatccattcccctttgacagaaatgggaatgcactatatgacctgtgtgaatcaaactggaaatgtttctttgcaagattatcaacaagtctagatatacaaacatctgaggacgaggacgatggagacaatagccaagcatttagatgtgtgccaggaacagttgttagaactgtatgaagaaaatagtaataaccttacaaaacatatacaacattggaaatgcataagatatgaatgtgtgttattacacaaagcaaagcaaatgggcctaaaccacattggaatgcaagtggtgccagcattaacagtgtcacagacaaagggacaccaggccattgaaatgcaaatgacattagaaacactattaaactctgactatggtatggaaccatggacattgcaagacacaagtcgtgaaatgtggttaacagcacccaaatactgttttaaaaaacagggacaaactgtggaagtaaaatatgactgcaatgcagacaacattatggagtatgtatcgtggaaatatatttatgtgcatgacacagacaaatgggtaaaagtgacaggacacatagactataaagggttgtattatgtacatggcgggcataaaacctattataccaattttgaaaaagaggctaaaaaatatgggaactcattacaatgggaggtctgtattggtagcagtgtcatatgttctcctgcatctatatctagtactgtgcaagacgtatccattgctgggcctgcttcacacacctcctcctccaccaccaccacccttgcacaggcctcacctgcactgcccacctgcacctccgaggaacgcgtggacccgccgccatgtaaacgaccccgaggacccaccacaaacaccaacaacgccagggacaccgtcagtgtccgacacagcgactccgtggacagtacaaacaacaacatctaccctaacagttacaacagtaacaaaggacgggacaacaatttttgtacagctacgcctgtagttcaattacaaggtgatcctaattgtttaaagtgtttaagatatagattacatgcaaagcataaaacattgtttgtagcagcatcgtccacatggcgctggacatgttcagatacttccagtaaacatgcactggtaacattaacatatgttaatgaagagcaacgtgagcagtttttaaacactgtacggttacctccaacagttacatataaagttggatatatgtctttacaattgttataatgcttattgtatatatttaattgtataaattgtacatggaacatatacctatagatggtactataggggcaaccagcacatcattactgccagttgtacttgccctgtttgtatgttttgttagcattgtattaattatttacatttctgattttatagtgtacacatctatattggtactaaccttactgctatatatgttactttggcttttactaaccactgccctgcaattttatgtactaacactgtgtgtctgcttttttcctgcgtggtatctacatttctatattgtacatacacaagaataactattacaatgctaacatgtacctttgatgatggtgatacatggttgttattatggtttatattaaccttaattgttaccattgtggcattgttattaatgcactttaaatctgtaccatgtgttacatgcagtaaataagtgtttgtaaacgtggtgtggttggtataattatggcacacagcagggcacgtagacgtaaacgtgcctcagctacccaattatatcaaacctgtaaggctgcaggcacctgtccatctgatattattcctaaagttgaacataacactattgctgatcaaatattaaagtggggcagtttgggtgttttttttggaggactgggaattggtacaggctctggcacaggtggtcgaacaggatatattcctttgcaatctaccccacgtcctgagattccctctggccctaccacaaggccacctatacttgttgatacagttgcacctggtgacccctctattgtttctttggttgaagaatctgctattataaattcaggagctccggaattggtccctccgtcccatggtggctttgagattactacatcagaatccaccacaccagccatattagatgtgtctgttacaacacatactacctctacaagtgtatttagaaaccctagctttgcagacccatctgttgtacagtcccagccagccgttgaagctggtggacacatacttatctctacctcaaccatatcgtcccaccctgtagaggaaataccattagatacatttatagtatcttcttcagatagtaatcctgcatctagcactcccattccagcatctggtgcacgaccacgtattggcctatacagtaaggctttacaccaggtacaggtaacggatcccgcctttttgtcctctccccaacgccttataacatttgataatcctgcatatgaaggggaagatgttagtttggagtttgcacacaatactatacatcagcctccagatgatgcgtttatggatattatacgattgcacagaccagctatacaatctcggcgtggtcgtgtgcggtttagtagaataggacaacgggggtctatgtacacacgtagtggtaaacatattggtggcaggatacatttctatcaagacatatctcctatatctgctgctgcagaagaaatagaactgcaccctcttgtggccactgcacacgatactagcctgtttgatatttatgcagaacctgaccctgactttacagaagaacctgttccattgtctttttccacctccacgccctttcagcggtcttctgtgtcagccaccccatggggcaatactactgtccctctttcattacctggtgacatgtttgtacagcctggtcctgacataatatttcctactgcatccactacaactccctatagtcctgtcactcctgctttacctacaggtcctgtttttataagtggtgctacattttatttatatcctgcatggtattttgcacgcaaacgccgtaaacgtgtttccttgttttttgcagatgtggcggcctagtgaaaaccaggtatatgtgcctcctcccgccccagtatccaaagtaataactacggatgcctatgtcaaacgcaccaacatagtttaccatgctagcagttctagacttcttgctgtaggcaacccttattttgccatacgaccagcaaacaagacacttgtgcctaaagtttcaggatttcaatatagggtttttaaggtggtattgccagaccctaataaatttgcattacctgacacatctatatatgaccctactacgcaacgcctggtatgggcctgcattgggttggaagtgggtagaggccagcccctgggtgttggtattagtgggcatccattattaaacaaattggatgatgtggaaaattctgctagttatgcagccagtccaggtcaggacaacagggtaaatgtggccatggactataaacaaacacaattatgtttagttggctgtgcacccccattgggggagcattggggtaagggcaagccatgtaataatggtagtgtaaatagcggagactgccctcccctggaattaattactagtgttatcgaagatggtgatatggtggacactggttttggagccatgaatttcgctgaattgcaaccaaataaatctgatgttcccttagatatatgcactgctacatgcaaatatcctgactatttacaaatggctgctgatccatatggggacagattgtttttttacttacgaaaggaacaaatgtttgcaagacatttttttaatagggcgggaacggttggagaggacattccacaggatttggtttttaaaggtgctactaaaagtacagttcctaatgccatatactttaatacacccagtgggtctcttgtatcttctgaaacccaattatttaataagcctttttggttgcaaagggcgcagggccacaataatggtatttgttgggggaatcagttatttgttactgttgtagatactacacgtagtacaaacatgacaatatgtgctgctacaactcagtctccatctacaacatataatagtacagaatataaacaatacatgcgacatgttgaggagtttgacttacagtttatgtttcaattatgtagtattaccttaactgctgaggtaatggcctatttacataccatgaatcctggtattttggaacagtggaactttgggttgtcgccacccccaaatggtaccttagaagacaaatacagatatgtgcagtcacaggccattacatgtcaaaagcctccccctgaaaaggcaaagcaggacccctatgcaaaattaagtttttgggaggtagatctcagagaaaagttttctagtgagttagatcaatatccccttggtaggaaatttttattgcaaacgggtgtgcaggcccggtcctctgttcgtgtgggtagaaaacgtcctgcatctgcagccacttcatcctccagtaaacccaaacggtctaggaagaagtagtatgtgttattgttttgtttgtgtatgtgtgtcatatgttattgtttgttatatgtgttgtattgtatatatgttgtatgtctatgttgtgtaatgttgtatgtatgcatgtgtgtgttgtatttaataaacttaatctgtgtgtcctgttccaccccatgagtaagtgttgtagtattgtgtgttatgtctggtgtatacaatatacaacatatgtacagccatgttgttttataaaacacatttttaaacatattcctccattttgggtgcaaccgttttcggttgttactcatcacccacatcctgtaaccaatttgttgtagcaagcaaaatatttaatcttatctatagttgccaaaactttactatgttactaagtacacacctggcgcacagctaggcgcggtttggcaactacacaatacattcctaatctatataacactgctgtctacttgtttaacaatcgtgtgctggtagccaacttttaaaagcatttttggctactaacactacatttttgtacagttactgttagttttataaaatgagtaacctaaggtcacacacctgcaaccggtatcggttgaaacacaccctgtacatttccttattatagt

SEQ ID NO: 36 - DNA, 7989 bp, Human papillomavirus type 61
taacaatcatatatgtaaaaagtaggttggcaccgaaaacggtcggaccgacctgggtacatatataaagaaaccgtagggtcagcaaagcacactcatctatgggaccgtgcaatccaactaatattttcctgctctgcaaggactacgaggtggactttgaggatttaaggctgacatgtgtattttgcaaaaatgaattaacaacagaagaattgctggcgtttgcactaaaggagctaagcattgtgtggagacataactggccatttggagtatgcgcaccatgcttggcacgtgaagtaaaagtgagggagctgcgacattgggaccattcctgttacggacccactgtggaacagacaacaggacggtcattagctgaactatatatacggtgccatgcatgcagcaaaccgttaagtatacaggaaaaggagcatcaggtacaggcatacatccacttccactatatagctggacagtggacgggaaggtgttgccagtgtagagggccatgcacggccaggtggcaaccataaaggacatagtccttgaagagcgtcctgaggtggttgacctacattgcaatgagcagttattagacagctcagagtcagaggaggaggatagtgtgcgtgagcaacttgttgaacaagcacagcaggcctacagggtggttactacctgtggcatttgtaagtgtccagttaggctggtggtgcagtgcggagacgcagacctgaaggtgctacatgaactactgctgggcgacttgtccatagtgtgtcctggctgcgcataagggacatggctgacagtgaaggtacagaaagcggggatgggaccgaggccgcggaacgcgcaggggggtggtttctggtagaagccgtggtagaccgcaccacaggataccaggtgtccagtgatgaggaggacaatagcattgacacaggggaagacctagtagacttcatagatacaaggcgccccggggatgggcaggaagtgccgcttgcgttgttcgttcaacaaaatgcacaggatgacgctgcaacggtgcaggcactaaaacgaaagtatacatgtagccctgcaagcagcacctgtgtgtccttggtggacagtgaattaagtccccggctggacgccatacggatacaccggggacaggacagggctaggagaaggctgtttgagcaagatagtggctatggccatacgcaagtggaaattggagcatcagaaagtcaggtaccgggggatgcgcaacatgagggggggggggaatccgtgcaggaagcagaggaggagcgtggggggggggacggagaggccgaggccacaggtaaccaggaaacgcaagcgcaggagcaggcggcagacatattagaggtgtttaaggttagtaatttaaaagcaaaattactgtacaaattcaaggacctatttggactagcatttggggagctggtaagaaattttaaaagtgataagtcaatatgtggggactgggtaatatgtgcgtttggtgtataccatgctgtggcagaggctgtaaaaaccttaatacaacctatatgtgtgtatgcacacatacaaatacagacatgccagtggggaatggtaatattaatgcttgtgcgatacaaatgtgggaagagcagggaaacagtagcacacagcatgggaaaactgttaaacataccggaaagacagatgctaattgaaccaccaaagattagaagcgcaccgtgcgcactatattggtatagaacagccatgggaaacgccagcgaggtgtatggcgaaacacctgaatggatagtaagacaaacagtggtaggacatgcaatgcaagaagcacagtttagtttgtccatgttagtgcaatgggcatatgacaatgacataacagatgaaagtgtgctggcctatgaatatgcattgctgggaaatgaggacccaaatgcggcggccttcttggccagtaactgccaagcaaagtatattaaagatgcaattacaatgtgtaagcattatagacgtgcagagcaggcaaaaatgacaatggcacagtggattacacatagaggccgcaaggtggcagacacaggggattggaaggctattgtaaagtatttaagatatcaacaggtagaatttgtaccatttattagtgcccttaaattgtttctaaagggggtaccaaaaaaaagctgcatggtattttacggaccaagcgacacagggaagtcgctattttgcatgagcctactaaattttctgggaggagctgtgatttcatatgtaaattcaagcagccatttttggttatcacctttagcagatactaaagtgggactactggacgatgccacctatcagtgctggcaatacatagatacatatttacggacagtattagatggcaatgccataagcatagataggaaacacagaaatttaacacagctgaagtgtcctccattaatgataacaacaaatataaatccactagaggatcctacgtttaaatacctgcacagtagaatagtggtgtttcagtttttacataagtgtccactaaacagtaatggggacccagtatataccctgaataatgaaaattggaaatcatttttccgaaggtcctgggcacgcatagagggatctgatcaacaggaggaggaggaggaggaggatgaggatggagtcactagccgaccgtttagatgcgtgccaggagaaattactagacctctatgaaaaagatagcaacaagcttgaggaccaaatattgcattggcactatgtgcgtttggaaaatgcaatgttatttaaggcacgacaagcaggactaacgcgtgtgggccaccagatggtgccaacacttagtgttacaaaaggcaaagcacataaagcaattgaagtacatctgtcattgcaagggttacaaacaagtgcatatgcgcatgaaccctggacattgcaaaccacctctttggaaatgtggaatacgcagccacaacgatgctggaagaaaaaaggacgcagactaacagttaaatttgatggcgaggaccacaaagcagtggaatacgttagttgggggtatatttatgtacaaagcacagaaactgatctgtggtataaggttcctggaaaagtgtcatataagggcctatattatgaaatggagggacaggaacactattatgtgacatttgcacaggaggcccaaaaatatggggaaacaggcaaatgggaggtacatatgggaaacacagtgatttatgaaccctgcgcctctgtatctagtacccaggacgccgtgcgagaagtatccactgctgaaactgctggacacctgcgggacaacaccacacagaccaccaccacccccacgtgcgtgggccccacccagacatccacctcggtgcagacgccgcctcataagcgacagcgactccacagagacagagagcagcagcccgacacaacacaaaaagacaaccacaagcgggtggacagtactgaccagtggatcaacggtcaccgtaacagcacagaaacaggggacaactgtgacagttacagttcacctgtaatacacctaaaaggtgatccaaataaattaaagtgttttcggtataggttacaacattcagtacctgagctgtttgacaaagcatcatccacatggcattgggccggtggacaaagtacaaccagagcagcatttgtaacattgtggtatgttaatgtggaacaacgaaaacaatttttaaatcgtgtaaccattccaaagggtatacaagccactgcaggctatatgtcaatgtgtatataagtgtgtgtatacaaaaacataaatactgtgttgcaagtattgagccagctacagctatttacataccacacctgcattattgtgtaaaccataaacaatcctggacgagcttgtgtgtttgatagatggatggtgtacgatactcctgctgcttatacttttctggctttcctatctttcctcactaagcgcatttttggtgtttttctgtgccatatatgtaggattgttgtgcatatacatgcaagtgttgtggtatatggaataactgtggcgccaccagccatacactgctgctcatatgtaaatagtgttccttgtgtctgttgttcgtttgcaatatgtatccccttgtagttagttcccctcaggggtttgcattactggttgtggatcagcaaaactgcggattgttatttttgtttttgctattactgcttattgcaatactgttgtacaggcttttacattaggtggtgtaccttgtgtgttttccctccccacagttttttactttgttatatttttatatgtttatggcctaataaacattatggctcttaaacgtcgcaagcgtgcatctgcaactgacctctatcgtacatgtaaacaatcaggcacatgtccccctgatgttgttccaaaggtggaaggggatacccttgctgaccgcattttaaagtgggctagtttgggggttttctttgggggattgggtataggcaccggctctggtactgggggtcgtactgggtatgtgcctattggcacccggcctcctactgtagtggatattggccctgtgtcccgcccccctgtagttattgatccagtgggtgctgccgatccctctatagttacccttgtagaggaatccagcgtcattgaggctggggctacagtccctacattttccgggtccgggggcttcaatgtcacgtcgtcttctactaccaccccggctgtgttggacattactccatcgggtgggtctgtgcaggttagcagcaccagttttattaatcctttattcactgagccttctattattgaacctcctcaggcaggggaccttgccggccatgtcatttccagtacccctaccgctgggtcccacagttttgaggaaatcccaatgcacacctttgctacctctgagggtcctggaagtagtaccccgctgcctggcatccgtcgccttgcacggccccgcctgaatttatacagtaaggctaaccaacaaattaaggttgctaaccctacatttatgtctgatccagcctccttaattacatatgacaatcctatatttgatcctgaggaaactattatatttgaacatcctagtatatatacacctcctgacccggactttttagatattgtgtccttacacaggcccgcgctcacatcccgccagggaactgtacggtttagtcgccttggtcaacgtgccaccttgcgtacccgtagtggtaggcgcattggcgctcgggtacacttttaccatgacattagtcccattccatcggatgctgtggagttacagcctttggtgccgtcctcgtcccctagtataacatatgatatatatgctgaccctgaggtgttggatcttcctgcacaacatacacaacccacacttacagtacagggcccttccctctctgctgcatctgcatctaccaaggtacacaatgtcactgttccactggccacagggcttgatacgcctgtgacatctggccctgatgttgattttgcacatgctcctgcgcctgtaccagctgtaccatatgtacctgccacccatccacattctatatatattcagggctctgatttttatttgttgcctgcttatgtgttttttcctaaacgtcgtaaacgtgtaccctattctttttcagatggctttgtggcggcctggtgacggcaaggtatacctgcctcccactcctgtgtctaaagttatcagtactgaccgttatgtgcaacgcaccaacttattttattatggtggcagttcccgtctgcttactgtaggacatccctattgtagtttgcagcttgatgggctgcagggcaagaaaaacactatccccaaggtgtctggctatcaatatagggtgtttagggtacagcttcctgaccctaataaatttgctttgcctgatggcaccttgtataatcctgatactgagcgcatggtgtgggcctgcaggggcattgaggttggtagggggcagccattgggggttggtactagtggtcacccgctgtacaatcgcctggatgacactgaaaacaccacattacttgttgcagagtcctctgacagtcgtgacaatgtgtctgttgattataagcagacccagctacttattgtaggttgcaaaccccctattggggaacactggacaaagggtactgcttgtgctaaccccgcgccccggcccactgactgtcctccattggaatttacaaataccaccatacaggatggcgatatggtggaaacaggctatggggccattgattttgctgcattgcaggaaaataaatctgaagtgccattggatatttgcaccactatatgcaagtatcctgattatttacaaatggctgctgaaccatatggagactgtatgtttttttgtttacgcagggaacaaatgtttgctcgccactttttcaatcgccagggtgtcatgggtgaggcactgcctgactcttattatcttaagggtgcgaatgacaaggcggcccctggtagttatatttattcccctacgcctagtggctctatggtgtcctctgattcccaattatttaataagccatattggctgcaacgtgcccagggccacaacaatggtatttgttggtttaatgaattgtttgtaaccgttgtggataccacccgcagtactaatttaaccatttgtactgctacatccccccctgtatctgaatataaagccacaagctttagggaatatttgcgccatacagaggagtttgatttgcaatttatttttcagttatgtaaaatacatttaacccctgaaattatggcctacctacataatatgaataaggccttgttggatgactggaactttggtgtggtaccaccaccctctaccagtttagaagacacatataggtttttgcagtccagagctattacatgtcagaagggtgctgctgccccgccgcccaaggaggatcgctatgccaagttatccttttggactgttgatttacgagacaagttttccactgatttggatcagtttcctttggggcgcaagtttttattgcaggccggtccccgctcagtatctgtgtcacgcaaacgtgctgcccccagctctacccctacatcctcccctgctacaaaacgcaaaaagcgtaaacagtagtgatgtttgtctgtatgctgttgttgtgcatgtgttgttttgtattgtgctgtactggccttgtgcatgtgctgtttgtatggtgcctggtttgtatgactgtatttgctatggttgtgtattgtgtgaccctgtactgacccttgtcccctgtgttgtgtatctgtggaatgtgtgttacactgtgtgtgcattaataaactgtgtgtcatgtgtgtgtggtgtccggtgcaccctgtgagtaagtgtgtttattgttgcacgccttattttgtgcagcttccccatttctgtgttccttgtgttcgggtagccattttgtgttgccgaccgttttcggtctcccgccttttttgttgccgaccggtttcggtcgcccgcctttttggttgtggcactatgccactgtacacataccacatcctgtttaaacaaactttatgtgttgcacctgggtgtgtttgacaggttgctaacacacacagtttggaacaatgctccatctatcttttttgacatgttgtgcaattactgtgcttttaggcacatattttgtgctgactactttcccttaattgctggtttggcattgcttgtatacttttctagccaggaaactgtcttgcaactttgggcatgttttacacacattatgttacaaagccgatccggtcgctccctatgtctcattctttttatgatagttta

SEQ ID NO: 37 - DNA, 8092 bp, Human papillomavirus type 62
atgactgcagggccagcaaggcccacgaacctgtttttgctgtgtaaggagtatgatgtggacctggacgacctgcacctaacctgcatattttgcaaaacagacctgtccgccggtgaactgctgtcctttgcaatacgggagctacacgtggtgcggcgaaaggactggccatttggagtatgcgcagcatgcctattgagagagattaaagtaagagagctacggcggtggcagcactcatgctttggaataacagtagaagaggaaacaggcagtccgcttgcacaaatatatattagatgccatgcatgctgtatgccattaacctgtcaggaaaaggagtatcaggtagagaggggagtgcacttccacaaaatagcaggagtgtggacaggacggtaccgcaattgtagaggagtatgcacggccaggcagcaactataaaggacattgtcctacaagagcgtcccgatgtggttgacctacattgccacgagcaattgttagacagctcagaggaagaggtggatgatagggacagtgctgagcaacctgtagaacgggcacagcaggcccatagggtggttactacgtgtggtatttgcaactgtttagttaggttggtggtgttaagtggagacgcagaactcagacggctgcaacaactactgacggatgcactggagatagtgtgtcccggctgcgcataagtgacatggccgatgcggaaggtaccaatggcggggatgggatagatggtacaaacggggccggagggtggtttatggtggaagtcatagtagaacaaacaacagggtaccaggtgtccagtgatgaagatgaaaacagtatagacacaggggaagatctggtagactttatagacaataccagacatcccggggacgggcaggaagtgccgttagaattgtttgttcaacaaaatgcacgggatgacgctgcagctgtgcaggcactaaaacgaaagtatacatatagtcctgcaacaagctcatgtgtatcctgggtggactgtgaattgagcccgcggttgaacgcaataagcctagaccggggacacgaaagggccagaaggaggttgtttgaccaagacagtgggtatggccatacgcaggtggatacgggaccatccgaaggacaggtaccgggggatacacaacaaacagatgaaaacgtagagcaggaagtgcaagaggatgtaaggggggggggggatggggaaccggaacgcagtgtagatgtgcaacaatcgcaggaacgcacagcaagtattgtagagctgttaaaaaccagtaacctgcgagcaacactgctaagtaagtttaaggagctgtatgggctggcatttggagagctggtaagacaatttaaaagtgataaatcagtgtgtggggactgggttgtatgtgcctttggtgtataccatgcagtggcagaggctattaaaacattaatacagcctgtgtgcctatatgcccatatacaaagccaaacctgttcgtggggtatggtaatattaatgcttattagatttaaatgtagtaaaagcagggaaacagtggccaaatgcattggcacattgctaaatgtgcctgacaagcaaatgttaattgaaccaccaaaaattagaagcgcgccctgcgcactatattggtttaggacggccatggggaatgcaagtgaaatattaggggaaacacctgagtggataacaagacaaacagttgtgggacatgcaatgcaagaaacacaatttagcctatcagtgcttgtacagtgggcatatgataatgatatagtggacgaaagtgacctagcatatcaatacgcattgctgggcaatgacgaccccaatgcagcagcctttttagcaagcaactgccaagcaaagtatataaaggatgcaattacaatgtgtaaatattataaacgggcagaacaaaaacgtatgtctatggcacagtggatagcacatagaagccaaaaggtagctgatacaggggactggagacctatagtacggtttttaaggtatcaaaaaatagaatttgtgacatttatgagtgcactaaaaatgtttttaagaaatatacccaaaaaaagctgtatagtaatatatgggccaagtgatacagggaaatcattgttttgcatgagcctattaaagtttttaggaggggcagtaatatcctatgtgaattccaccagccacttttggttatcccccctaacagatgctaaagtggggctactggacgatgccacgtacccatgctgggtatatatagatacacatttacggagcgtgctggatggaaaccaaataagcatagatagaaaacataaaaacctgacacagatacaatgtcctcccttatttattaccaccaatataaatcctttggaagacgcaaatctaaaatacctgcatagtagaattgcagtattccactttatgtacaagtgtccattggatgacaagggggacccagtgtatcaatttaataatgaaaactggaaatccttttttcaaaggtcctgggcacaaatagagggtactcctgaggaggaggaggaggaggaggaggaggacaatggcaacactggccgaccgtttagatgcgtgccaggagaaactaatagacttttatgaaaaggatagcgacaagcttgatgaccaagtaaaacactggcagtgcatacgcctggaacatgccattttatttaaggcaagacaagcaggactaacacagttgggccaccaggtggtgccagcacttagtgttacaaaaggaaaagcccacctggcaatagaagtgcatttagcattgaaaagtttatatgcaagtgtgtataaagacgaaccatggacattgcaaagcacgtctttggacatgtggaacgcaaagccacaaaaatgctggaagaaaaaaggacgaacagttacagttaaatttgattgtgaggactctaaaataatggagtatgtaagctgggggtacatatatgtgcaaacagataccgagcaatggtgtaaagtacaaggaaaggtaagctatgaagggctatactacgaactggagggccacagacactactatgtagtatttgcagacgaggctaaaaaatatggggaccttgacaaatgggaggtccattgggggaacacagtgatttatgaaccatgcaactctgtatctagcacccaggacattgtgcgagagataccccctgctgaaactactagactgctacacacccccgaacccaccaccagtgcccagcacgtgggcaccacccagaccaccaaagccaccccggtgccgacgccgccttgtaagcgacagcgagtccacggacacggagcggagcggcagcccaccgttacagaagcggacagcagggtcgtggacaataacgagtacgggaccaacagttaccctgacagcacaaaaggacgacacgtgtgtgacggtggcgctgcacctgtaatacacctgcgaggtgaaccaaacaaattaaagtgtcttagatatagattacgcgggtctgtaccacatttatttgtaaaggcgtcctccacgtggcattggacctgtggggacagcacagaaaaggatgcatttgtaacattttggtatgccaatatagaacaacgcacagaattcctgcaacgtgtaacaataccaaaaggcatacaagcaatgcaagggtatatgaccatgtgtatgtaaccatatatatatgtacatatatattactgtaatcacatatagctacgtgtgtaaacaatattgtttgtgctgtatctgagccaggtttatacagtaaggtaccacacctgcattgtgcaaacgttaccaatcctggataacttgctatgttgtatatgtgggtggtgtgatgtgcttttgctgcttatacttttctggctttcccagctgtctgccctaactgcctttgctgtgtttttttgtattatatatgtgggatttgggcttttgtatttgcaggttatgtggtacattggtatgctgtaaaccacaaccagccaaccactgctgctattgtgtatatacatagtaggtgtatttgcaggtgtttagtaggtatgcatcctgttatggtacgctcctatgacgggggcaccgatattgtggtgttggggtctgatgacagtggtctactgtttttattgtgcctcatagtggcattaatactgtttgctatatacaagttgttgcaattgtaactaccagcgttgtacataccatatttctgttattgttgctttattttttatattttgtatgttgcaataaatacatttatacattggctttcaatatgcccaaggtactgcatcgtcgcaagcgtgcatctgccactgacctttatcgtacctgcaaagtatcaggcacgtgtccttctgatgtcattcccaaggtggaaggcaatacattggcagataaaatattaaagtgggccagccttggggtattttttgggggtctaggtattggtacggcctctggcacgggtgggcgcaccggctacatacctatagggggccggcccccgtctgtggtggacattggccccgtgtcccgcccccctgtggttattgaacctgtgggcgctacggatccatctattgttacccttgttgaggattccagtattattgaggccggggctgtgcatcccaattttacagggtcctcagggtttgaggtcaccacatcctctaccgccacccctgctgttttggacatttcccctaccggtaccactgtacaggttagcagtaccaactttttaaatcctgcatatactgagccatccattatagaccctccccaaactggtgagctttcgggtcatgtgcttaccagtacacccacagctgggtcacacagttatgaggaaatccctatggttacctttgcatcaaatgctggtacaggctctgaacctattagtagcaccccattgcctggtgtgcggcgcgttgcagggccccgccttggtttatacacaaaggccactcagcaggtgcctgtggctgaccctgcctttgtgtctcgtcctgcatcctttgcaacattcgacaatcctatatatgaccccgaggaaactattatttttgagcaccccagtatttacacaccgcctgatcctgactttttagatattgtgactttacacaggcctgctttaacctctcgccagggcactgtacgccttagtcgtgttggccagcgtgcgtcattacgcacccgtagtggtaagcgtattggggccagggtacacttttaccatgacatcagccctatacccagtaccaccactggtgacattgagttgcagcccttgctgccttctggctcctcctctgctgatacattgtatgatgtatatgcagatgaccagcaccttgatgctgtattacagtctgtgccttctatgtcttccaggcccttggttcccagcaatgccaccatatctgccacgtctgtggcatcctctcatactaatgtcactgtaccattatccactgggttgtccgttccagcgtccactggccctgatgtggaattgcctcagttttctgtacctgtgtctgtgctaacgccttccttccctgcaactaccccatattctatatatattgtaggttctgattattatttgttcccttcctatatttttttcccaaaaaaacataaacgtcttcactatttttttacagatggctatgtggcggcctggtgacggcaaggtatacctgcctcccactcctgtttctaaggttctcagtacggacacctatgttacacgcaccaaccttttttattatgggggcagctcccgccttcttactgtgggacatccatattgtactttacaggttggccagggtaaacgggccaccattcctaaggtgtctgggtatcagtacagggtgtttcgtgtgaaattaccagaccctaataaatttactttacctgatgcaaccttatataatccagacacggaacgcatggtatgggcctgcaggggcattgaggtcggccgtgggcagccactgggtgttggcaccagtggccacccgttatataacaggttggatgatacagaaaatacctctttgttggctgctgctaatgatgacagtcgggacaatatctctgtggattataagcagacccagttgttaattgtggggtgtaagccccctataggagagcactggaccaaaggtaccttatgccccaatgctgccccggcccccacggaatgccctccgttggaatttaaaaatacaactattcaggatggtgacatggtagaaacgggctatggggctattgatttcaaaagcttgcaggaaagtaaatctgaggtgcccttggatatatgcacctccacatgtaaatatcctgactatttgcaaatggctgcagaaccttatggcgattgtatgtttttttgtttgcgccgtgagcaaatgtttgccagacatttctttaacagacatggcactatgggcgaggccctgcccactgacctgtatatgaaaggtaccccaggcagtgacagacaaatgccgggcagttacatttatgcccccactcctagtgggtctatggtgtcgtctgattctcagttgtttaataagccatattggctgcagcgggcgcagggccataataatggtatttgttggtttaatgaactgtttgttactgtggtggatactactaggagtactaattttactatttgtaccgcctccactgctgcagcagaatacaaggctaccaactttagggaatttttgcgacacacggaggaatttgatttgcaatttatatttcaattgtgcaaaatacagttaacccccgaaatcatggcctacctgcataatatgaacaaggaccttttggatgactggaactttggggttttacctcccccttccactagtttagatgagacatatcactatttgcagtctcgggctattacatgtcaaaagggggctgcttccccgtcccccaaggtggacccgtatgcgcaaatgacattttggactgtggatcttaaggacaagttgtctactgatttggaccagtttcctttggggcgtaagttcttgctacaagcagggtctcgccctcggtctgttgctgtgtcccgtaagcgttctgcacctactaagcagtcccctacctctgctaaacgaaagcgcaggaagtaactgtatgtatggtatgtgtgtgtgtgctctgtactgtgttgtgcgcgtttgtcagtgtgttttgttatatgtatgtatggcctgtttgtatatgttgtgtatgtacccccctcctcccgctgttgtatatgtatttatggaatgtatgtgttgtttgtgcattattaaactgtgtgtcactgtgcctaatgtccggtgcgccctgtgagtaagtgtgtgtgtgtgtatttgtttgtacgccttgcacactatgttatttccttaccactccttacattagtgcctccattttgtgtgctacattttgtatgaccccattgtgttaccccgaccgttttcggttgcgcgcctttttggtttctatagtggcacactgccacactgtacacaaaaggtttctaatccttaggcaactcatttcctgcgttggcagcatactgtgttttacacctgggcgtgcctgacatattcttggcggcctacaactgttttgcacacaaattatacagtgcacttactcattttgcaataaaactgcttttaggcacattctttgtgctgactaccatgtcctaattgctggtttggcttttataaactttctacaagccaactatgtgtcctataaactaagcatgctttgtgcaaacctgttttaacatacaaggtggggcaatgtgtaagtctacttttcccttataataatttacaacaatcatctgtataataaagtagggaggtaccgaaaacggtcgaccgggaagggtacatataaaagcaaaccgtgtggtcagcacagtagca

SEQ ID NO: 38 - skipped

SEQ ID NO: 39 - DNA, 7801 bp, Human papillomavirus type 67
ttataatcctgtgtttaaaaaagtaggtgtaaccgaaaacggtttgaccgaaaacggtaaatatataaagcacaccagtgtccacctacagtgcaagaaatatgtttcaggacacagacgaaaaaccacgcaacctgcacgaattgtgtgaagctttggaaaccacggtgcatgaaataagtttgccctgcgtgcagtgcaaaaaaactttggacagaaacgaggtatatgactttttatttactgatttgaaaatagtatacagatgtgggaatccgtatggggtatgtaagcaatgcctaagactgttatcaaaagttagtgaatatagatattttaactattcagtatatggaaatactttagaagaaattgtgcataaaccattaaatgaaattacaatacgatgtataacatgtcaaagaccattgtgtccacaagaaaagcaaaggcatgttgatcgcaaaaagcgatttcataatatttccaatcgttggacaggacggtgttcagtgtgttggagacctcaacgaacgcagacccaggtataatatttgaagccatgcgtggagacaaagctacattgcaagattatatactagatttaaaacccgaaacaactgacctatactgctatgagcaattgcatgacagctcagatgaggaggatgaagtaggcatggaccggccagatggacaagcaaaaccagatacaaccaattaccatattgttactgtgtgtaacatctgtgagtgcactttgcgtttgtgcattcacagtacagcagcagacgtccgaacaatccagcagatgcttatgaacacactaggaatagtgtgtcccacctgtgcacaacaataaacatcatctgaaatggaggacccggaaggtacagacggggaacagggggggtgtacaggatggtttagtgtagaagcaataattgaaaaaagaacaggagataaggtatcagaggatgaggatgaggatgcatctgacactggtagtgatttaattggctttatagatgatacacatatagaaaacatacaggcagatacacaggcagcccgcgcattatttaatttacaggaagaggaggatgacctaaacgctgtgagtgcactaaaacgaaagtttacaggcatacaggcatgtggtggtaatagtaatggtatagaaaaccaagcatgtacagccgcaaaacgcagagcatacgacatagaagacagcggatatggcaatactgaagtggaaactcaagagacaatggtgcaggtagaggggcaaaatggcgatatgcagtgcagtagtcagtgtagtacgggggcaagtagtacgggaaacagtgtagatatgcaatcggaaagtaatagtagtcaggaacaaagcatgccattgcaaactgtggaaaatattatgcatgtaaataatataaaggcaacgttaatgcataaatttaaggaagcatatggggtaacgtttacacagctaataagaccatttaaaagtgacaggacaagctgtacagattggtgtgttacagcgtttggaataacaccatcagtagcagaaagtttaaaggtgttaatcaagccacaaacgttgtacacacatttacaatgtttaacctgtgacagaggtattattatattattattagtaaggtttaaatgtgcaaaaaacaggttaacagtgtcaaaattaatgtctaatttattatcaattcctgaaacgcatatgataattgaaccaccaaaaatacggagtacaacgtgtgcactatattggtttagaacaggaatgtcaaatataagtgaagtaagtgggcaaacaccagaatggatagaaagactaacggtactgcaacatagttttgatgatactatatttgatttaggagaaatggtgcaatgggcatatgacaatgacataacagatgatagtgaaatagcatatcaatatgcaatgctggcagatgtaaacagtaatgccgcagcatttttaaaaagtaattcgcaagccaaaatagtaaaggattgtggtaccatgtgcagacactataaaagagcagaaaaacgaaaaatgacaataggacaatggatacaagctagatgtgaaaaagtaaatgatggaggagactggagaacaatagtaaagctattaagataccaaaatgtagaatttacacagtttttagcaacatttaaaaagtttttaaaaggtatacctaaaaaaagttgtatggtaatatgcggaccaccaaacacagggaaaacatattttgcaatgagtttaatccactttttacaaggatgtgtaatatcatatgtaaacgccaaaagtcatttttggctacaaccattgtcagatgcaaaaataggaatgatagatgatgttacagcaatatgctggacatacatagatgattatttaagaaatgcacttgatggaaatgatatttcaatagatgtaaagcataaagcgttagtacagctaaaatgtccaccattactattaacttccaacatagatgtagcaacagattcaagatggccgtttttacatagtagagtagtagtgtttagatttaacaatccatttccgtttgatgaaaatggcaatccagtatataacttaaatgacgaaaattggaaatcctttttctcaaggacgtggtgccaattagatttaattgaggaagaggacaaggaaaaccatggaggaaattgcaacacgtttaaatgcagtgcaggagaaaattctagatgtatacgaagctaataaaaaagacttatgtacacaaattgaacattggagactgagacgcattgaatgtgctttgtattataaagctaaagaactgggactggcacggataggccaccaggtggtgccacctatgtcagttacaaaggccaaagcctgtcaaataattgaactgcaaatggcattacaaacattaaatgaaacacaatatagtaatgatgaatggacattgcaaagtaccagcctagaactatggttatgtgaaccaaaaaaatgtttaaaaaaaaaaggagagactgtaacagtgcaatacgataatgataaagaaaatacaatggaatatacaagttggaatgaaatatatatagtaaaggactctgtgtggacagtggtagtgggaaaggtggactatatgggactatattatatatatgaaacagaaaaaacgtattatgtaaagtttgaaaccgatgctaaaaagtattcaaaacaaaacatttgggaagtgcatgtgggtgctcaggtaattgtttgtcctacatctatgtttagtaacgaaatatccactactgaggttgctgcccggataccacacgccacagaaacgtatacccctgccaccaccgcgtgcaccaaagaaaaacaggcgcctgccaaacgacgacgacctgacgtcccagacttctgcaacaactcccagcaccccacaaagctattgtgcagacaacggtccgtggactgtacatcggtggggctcgtccctggacctcagtgcacaaacaaaggacggagtgtgtgtgcacctaacactgcacctatagtgcatttaaaaggtgaccctaatagtttaaagtgtttaagatatagattaaaatgtaatacagatttatattgtcatatgtcatccacatggcattggaccagtggaaaacatacaaaaactaaagaagctattgttactgttacatatgccagtgaaacacaacgacaacagtttttaaactctgtacgcataccccccactgtgcaaattgtttgtggtataatgtcattgtaatatattgtatattactacattacacacaagccaatatgtgctgctaagttgtatatataggtatactatacaatgctggccatttttgtatttgcatttgtgttgctgttgtgcttttgtattgtgctacgtccgcttttgctttccatatatgtgtatgcattattgctggtgctggtgctggtgctatggggttttataggttcccccttacgggtatttttggcatatcttatatttttgtacctacctatgatgtgtattcatttacatgcacagtatattgtttcctaatactttgtatactgtatgtatttgtacatatttattgttttgtgcacagtgtggtacaatggcatactttttatatttactaataaaccatttttttatttttactagtgtgtacaatgagacacaaacgatctacaaggcgcaaacgtgcctctgcaacacaactatatcaaacatgcaaggcggcaggcacctgtcccccggatgttattcctaaagtggaaagaaccaccattgcagatcaaattcttaaatttggcagtttaggtgttttttttggaggccttggtattggtactgggtctggtacgggtggtagaacaggttatgtccccttatctacacggcctcccactgcatctgcgcctacatctacaatacgaccccctgtatctgttgatactgtagggcccctagactcttctattgtgtctatgatagaagaaacaagttttattgagtcaggtgcacctgcaccatctattccaacagcatctggatttgatgttgcaacttctgcagacaatactcctgcaattattaatgtttcatctattggtgaatcttctgtacaatctgttaccacccatttaaatcccacttttacagaaccttcagtactccgcccattttcatcttctgaagcctctggtcatttaatattttctacacccactattagtacacattcatatgaggacattcctatggatacctttattgtttctactactagtgacaatgtaactagtagcacccctattcctaggcctcgccccacggcacgccttggtttatatagtaaaggcacacaacaagttaaggttgttgaccctgcttttttgacatcgcctcgtagattaattacatttgataatcctgcatttcaacctacagaacctgatgaaacactttactttcaacaccaagacatttcacctgcacctgaccctgactttttagacatagttgcattacataggcctgctttaacatctcgcaaaggcactattagatttagtaggttaggtagtaaggctacaatgaaaacacgtagtggcaaacaaattggtgctcgggtgcattattatcaggatttaagtcctatagtacctgctgactccatagaactacagccattatctcgccctgtgtcttctgcttcccattctattaatgatggtttatatgatgtatatatggatcctgacacaccctttccacagccatcaatatcctattcattacatagtcctcagaccaccaatgttactgtccccttaagtagtggttttgattttccattttcctctactgtaccattacagccaggtcccgatattgtgtcccctgtagcccctacatacactccttttgtacctgttatacctacatctccctttaacaatgtacttgtttatggtagtgattttattttacaccctagttattttttacgtcgcaggcgtaaacggtttccatatttttttgcagatgtccgtgtggcggcctagtgaggccactgtgtacctgcctcctgtgcctgtatctaaggttgtaagcactgatgaatatgtgtcacgcacaagcatttactattacgctggtagctccagacttttagctgtaggccatccttacttttccattcctaatccctccaacactaaaaaggtgttagtgcccaaggtgtcaggtttgcagtatagggtatttagggttcgtttaccagatcccaacaagtttggatttccagacacatctttttataaccctgacacacagcgcttagtatgggcttgtgttggtattgaaatagggcgaggacagcctttgggtgttggtattagtggacatccattacttaataagtttgatgatactgaaacaaataataaataccctagccagcctggtactgataatagggaatgcttgtctatggatgctaagcaaacccagctatgtattattggttgtaaacctcctacaggtgaacactggggtaaaggtaccccgtgtagtggtaacagtaatgggccaggtgcctgtccccctttggaacttatgaatactgttattgaggatggggacatgattgatactggttttggctgcatggattttaaatctttgcaggccaataaaagtgatgttccgttagatatatgtaccagtatttgtaaatatcctgattatcttggtatggctagcgaggcttatggggacagtttatttttcttcctgcgacgtgagcaaatgtttgttaggcatttgtttaacagagcaggtaaattaggggaggatgtacctacagatttgtattttaagggatctgcaaacacttctgcactgcaaacctcagctttttttcctactcccagtggctctatggtttcctcagaatctcaattatttaataaaccatattggttacaacgcgcacaaggtcataacaatggtatatgctggggtaatcaaatatttgttactgttgtagacactacacgtagtaccaacatgactttatgttctgaggaaaaatcagaggctacatacaaaaatgaaaactttaaggaataccttagacatgtggaagaatatgatttgcagtttatatttcagctgtgcaaaatatcccttactgcaaatgttatgcaatacatacacaccatgaatccagatatattagaggactggcaatttggccttacaccacctccttcaggtaatttacaggacacatatagatttgttacctcgcaggctattacctgtcaaaaaacatcccctccaacagcaaaggaagatcctcttaaaaagtacagtttttgggaaatcaatttaaaggaaaaattttctgcagatttagatcaatttcccttaggtagaaaatttttattgcaggcaggttttacagctaaacctaaactaaaacgttcttcaccttcttcttcctcttcctcctctgcaaaacgtaaaaaggttaaaaggtaattgtatgactgttgtgtgtttgtattgtttgtatgtatgatttgtatgtttgtgtaatgtgtatgttatgtgtatgcatgttccctgtgtctgtcaatttcctgtttttgttaataaacattacatacaatgttaactatattgttgtgtcgtgtggttgcacccaatgagtaaggtactgtccctatatccctgcccatgccatgcccttgcctatccctgtataattatatgtagcatactgtgtttggtatatttattacttttacttataacattacagtctccattttgggttactactccattttatatctgtaaccggtttcggttgctgttggcatagggttttggtattctaggtttcttgccaacattgttaatctttgtcttcctgcagtgcaatgcctttacttgctgttgctctcccgcctaaattgactcatggtattgcagtgcaacacgcccttttacatgttttaaactgcttttaggcacatatttttaccatgtttttattgcttaattgcacttttggcttgcacagcactattttattgggtttatgttactattgtaagccaacatacaccttgtaaaatgattcaaacccttactcacacaggtgtgtatgcaccggtttgggttaacatgttccaaccatattgttacattattataaa

SEQ ID NO: 40 - DNA, 7700 bp, Human papillomavirus type 69
cttttaacaatcatagttttataaaagggtgtaaccgaagcggttttaaccgaaaacggtgcatataaaagtaaaagacacagccatacacaaaaccagctatgtttcaagatcccagagaaagaccacgaacgatacatgaactatgtgaagctttgaatacacctttgcaatctttgcaggtacagtgtgtatattgcaagaaaacattagaatgggcagatgtatataactttgcaatatgtgatttaagaatagtgtatagaaatgatagtgcatatggtgcatgtaaaaaatgtataatattctattcaaaaataatagaatatagacgctacacatcgtctgtgtatggtgcaacactggaagcgcgtcctaaacgaagtttgtgtaatttgttaataaggtgtcatagatgccaaataccattgggaccggaagaaaaacagagaattgtggatgaaaagcgacggttccatgaaatagcagggtactggaaagggttgtgcacaaactgctggagaccaaggcgcgaagcaacagaaacacaagtataaataacaatgcatggagacacaattaatatacaggatgttatattagatttggtgccgcaacccgaaattgacctacagtgttacgaacaattggactatgaacaatttgacagctcagaggaggatgaaacagataatgtgcgtaaccagcaagccagacaagctgaacaagaagcgtgttatagaatagaagcggaatgttgtgtatgtaatagtatagtgcagctagctgtactaagcagtcgacagaacgtccgagcggtggagcagctgctgatgggcgacgtgagtttggtgtgccaccagtgtgctacatactaaacctgcaatggactgcgaaggtacagatggggaggggttggggtgtacagggtggttttcagtagaagcaatagtagaaaaacatacaggagaaacaatatcagaagatgaaatagagtatagtagcgatacaggatcagacctaattggatttatagatgatagtaatattagtgatggggcagagcaacaggtagcgcaggcattgtttcaggcacaagaaacacaagcaaataagaaggcagtgcgtgcattaaaacgaaagttactaggtagtcagaacagcccgttgcaagacataacaaatcaaagcaacagtcagcagagcacagacgaagtaaacaatttacaggctaaaaggagagcagtggacagtgttccggacagcgggtatggctatactgaagtggaaactcttacgccagtacaggtagataaacacaatgaacaaaatggcgatagtgtgtgtagtcagggggggtcaagtggatctgtatcagacatggaggtggacataggagcacaggcaagtagtgtaaccaaaatatgtgaattgttaaaatgtagtaatgtaaaagcagcattattaagcaaatttaaaacagtatatggtgtaagttatacagaattagtacgagtgtttaaaagtgataaaacatgctgttcagattgggtatgtgcagcctttggtgtggcaggctctgtagcagaaagtttaaaaacactaatacaaccatattgtttatactatcatattcaatgcttaacatgtaattggggagtactaccactaatgctaatacgatttacatgtgccaaaaatagagcaacaattaaaaaatgcctgtgtacgttactgaatgtgccagacacacagttgttaatagaaccaccaaaattacgtagtacagcagttgcattatatttttataaaacaggattatcaaacataagtgaaacacatggggacacaccagaatggatagtaagacaaacacaattagaacatagttttgaagatacaatatttgatttatcaaaaatggtgcaatgggcatttgatcatgacataacagatgacagtgaaattgcatttaaatatgcacaattggcagacatagaaagtaacgctgcagcatttttaaaaagtaactgtcaggcaaaatatgtaaaagactgtgcaactatgacaagacattataaaagagcacaaaaacgatccatgggcatgtcacaatggttacaacataggtgttcaaaaatagaagatggaggaacgtggaaggacatagcaagatttctaagatatcaaaatgttaattttatttattttttgcaagtattaaaacagtttttaaaaggaacacctaaacacaactgtatagtaatatatgggccaccaaatactggtaagtcacagttcgcaatgagttttataaaatttgtgcaagggtctgtcatttcatatgtaaactctaacagtcacttttggctgcagccattagaagatgcaaaggtggcattattagatgatgctacatatggctgctggctatacatagataaatacctacgtaattttttagatggcaatccctgttgtatagatagaaaacatagaagtttaatacaagtaagatgtccaccattaataattacctcaaacattaatccacaagacgacaattcattaatgtatttacatagtagagtaacagttataccatttccaaatacatttccatttgacagcaatgggaatcctgtatatgaattgactgatgtaaattggaaaagttttttttccaccacttggtccagattagatttggaggaggacgcggacaaagaaaatggagaacctttgccagcgtttaaatgcgtgccaggagaaaatactagactattatgaactggacagtgacaaattaagtgatcaaattgactattggaaactggtgcgatatgaatgtgcaatattttataaagctcgtgaagggaatatgcaatgtattaaccaccaggtggtgccatcgacaacagtgtgtaaagaaaaagcttggcaggcaattgaattacatatagcattacagtctttaatgaattcagaatatggaaaagagaaatggactatgagagacacgtgttatgaattgtatgtgacagagccaaaacactgttttaaaaaagaagggacaacagtaacagttgtgtttgattgtaataaggaaaatacaatggactatattaggtggacatctgtgtattataaaacagatatgggatggtgtaaaacaaatggagaagtggattataaggggatatactatatgcatgggtgttgtaaacagtactatgtggactttaaacaagaggcgttaaaatatgggactggtttgcaatgggatgtacatgtgtgtggtcaggtaatatgttgtcctgaatttgtatctagtacctccggggaccaaatatccactgctcaaactgctgaaccactatcaaacaacaccacccagacccccgaaaccacctgtgtgccccggtgcaccgaagaaaccccggcgccagagacagcaaagcgacgacgacttagtggacccaacacccctgtcaccaccaccagtgttacaaggcccagaagttccttggagcatacagacaacgtgttacacagtaacagtggaagcaacaacccgggaaggggcacgtgtagtgaccagactgtgtttatagtacatttaaaaggtgatacaaattgtttaaaatgtttaaggtatagatttaaaaaacataagggattgtattgtaaagtgtcatctacctggcattggaccagtaatactaaccaaggcattgtaacaattacatttgatagtgaaacacaacgtgctagttttcttacaactgttaagataccacagagtataacatcaacattgggtataatgtcattgtaatctatagtgtaacatatatacatcccacaagccaatatgtgctgctaactgtatatacataaccattttactacttgtaattgtgtttgtgctttgcgtgtgtgtgtgtttgttgctgtgtcgtttgttgccgcttttgctatctatacacgtgtttgcagcccatttattaataattatatgtttttggtttgtggtttcaacatcatttacagctacgttttttgtatatatttgtttgttttatatacctgcatttttgttacatttttatgctgtaattttactacctaatggtttataaataaacacttcataatggtggctgttcgtgcatcacgacgcaaacgagcatcagcaacagacctttacaaaacctgtaaagcagctggcacatgccctcctgatgttatacctaaaattgaaggctctactcttgctgataaaattttacaatggagtgggttgggaatatttcttggtggacttggtattggcacaggaacaggtactggtgggcgtactgggtatattcctctgggtggtggtggtaggccttctgtggttgatattggccctactaggcctcctataataattgaacctgtgggcccaactgaaccttccatagttactttagtagaagaatcaagtattatacaatctggatctccatttcctaattttagtggtggggatgggtttgaggtcactacctcctctactacaacccctgctgtgttagatattaccccctcccctggaactgtacacgttaccagcacaaatatacaaaacccattatatattgaaccacctgtagatattcctcagtctggagaggctttaggacacatttttactagcacatctactgccggtacacacagttatgaagaaatacctatggaggtgtttgcatctaatactagttccgggtcaaaacctattagtagtacccctatacctggcatacgtagggttgctgctcctagattatatagcaaggcctatcaacaggttaaggtcactgaccccaattttatttctaagccttccacatttattacctttgataatcctgcatatgaacctatggacactaccctcacattttctgcagatagccacgtggcccctgatcctgattttttggatattattgcattgcatcgccctgctcttacttctcgcagaggcactgtaaggtttagcaggttaggtcaaaaggccacacttaaaacacgtagtggtaaacaaattggagctaaggtacattattatcatgacataagtcctatacatgctacagaggaagctattgaattacaacctttaattacttcagaacagcactctacaccattgtttgatgtttatgctgatgctgaccctgcccctacatttacatttccatctactacacctactacaatccctagattttcttctacaatattttcaaccactagtagtgcacccttaaatgttaccatacctctatctacatcatttgatatacctatatataacggccctgacatttatgctcctgtaccttcttccacatggccttatattccacctccacccaccaccatgtcacattccgtagttgcacaagggggtaattattatttatggccttatatttatttaattcataaacgccgccgtaaacgtgtgccttgttttttttcagatggccttgcggcgtactagtgacagcaaggtatatctgcctcctacccctgtgtcccgggttgtcagacggatgaatatgtacacgcaccggatatattactatgcaggcagctctcgattattaactttgggtcatccctattttccaattcctaaatctggttcaacagcagaaattcctaaagtgtctgcttaccaatatagggtttttcgtgttcaccttccagaccctaacaaatttgggttgcctgacccccagttatataatcccgaaacagaacggttggtatgggcctgtgttggtgtagaggttggcaggggacaaccgttgggtgttgggctaagtgggcatcctttatttaataaattggatgacactgaaaattcacatcttgccactgctaatgcagacactgataatagggacaacgtgtgtgtagataataaacaaactcagttatgtattattggatgtacccctcctttaggtgaacactggggcgttggcactgtatgtaaaaatgcacagtctcaggtacagcgtggcgattgtccacctttggaacttatttccagtgttattgaggatggtgatatgattgatactggctttggtgccatggattttacagctttgcaagctacaaaatgtgatgtgccacttgatattaatcaatctatttgcaaatatccagattaccttaaaatgtctgcagatacgtatggaaacagcatgtttttttttcttcgtcgggaacaattgtttgccagacatttttttaataaagctggcactataggtgattctgtaccagtatctatgtatattaaaggcgctggtcaaggtcgtgaacctccaactacttctatatactcacgtacgcctagtggctccatggtgacctctgatgctcaattgtttaataaaccttactggttacagcgtgcccagggtcataataatggcatttgttggggcaaccaattgtttgttacttgtgtagatactacccgcagtaccaacctcactattagtactgtatctgcacaatctgcatctgccacttttaaaccatcagattataagcagtttataaggcatggtgaggaatatgaattacagtttatatttcaattgtgtaaaattactcttaccactgatgtaatggcctatatccatacaatgaattctactattttggaaaattggaattttggccttaccttgcctcctactgctagtttggaagatgcatataggtttattaaaaattcagctactacatgtcaacgcgatgcccctgcacagcccaaggaggatccatttagtaaattaaaattttgggacgttgatcttaaagaaaagttttctattgatttagatcaatttccactgggcagaaaatttatgctgcaggctggtatacagcgacgtcctaagttaggcaccaaacgtccagcttcttccttatctgcatcttcctcctctaccacacgtaaaaaacgcaaacttactaagtaattccacatggttgtgtcagtgtatagttttgtatgtgtgtaatgtaaggtgtgttgtgtttgtatgtataattgtatgtttcctgtgtgtgtttgtatgtatgtatgtatgattatgtgttttcctgtttgtgtggtttactgcatgcttgttatttaataaacaatgaatgtgttgtatttgttatttcttcctccgtagggtatagggaagtaacttaggtagtgttttaggtggtgttcctttttgcgaaccgaattcggttgcattcaactttatattatattttgcaggaacggttaatcctttggcacacaacacatcctgcctcctacgcttggcttgcctagacgtggctcacctacattactcacatatcttttaacaatagttgcatacgcacttttttttgattataataaaactgctgttaggcacatatttttattgtatacatgggttttactaagtgcatagttggctagcagttttactgttttatgccaactatatgtctgacacattccttttaacaataaaactgctgttaggcacatattttataagctacttagacacaggtgtggtaacaaccgaaatgtgttttgcctttacatgcaactttctttctaataa

SEQ ID NO: 41 - DNA, 7905 bp, Human papillomavirus type 70
cttataacattttacaatcataatttaaaaaaagggaggcaccgaaaacggtcacgaccgaaaacggtgtatataaaaccatgcaaaagttgcttgcccatacggaatggcgcgatttcccaatcctgcagaacggccatacaaattgcctgacctgtgcacggcgctggacactacattgcacgacattacaatagactgtgtctattgtaaaacacagctacagcaaacagaggtatatgaatttgcatttagtgatttatttatagtatatagaaacggggagccatatgctgcatgccaaaaatgtattaaatttcatgctaaagtaagggaactacggcattattcgaactcggtgtatgcaacaactttggaaagcataactaataccaagttatataatttatcaataaggtgcatgagttgcctgaaaccattgtgtccagcagaaaaattaaggcatgttaataccaaaagaagatttcaccaaatagcaggaagctatacaggacagtgccgacactgctggaccagcaaccgggaggaccgcagacgtatacgaagagaaacacaagtataaatataaatatgcatggaccacggccgacattgcaagagattgttttagatttatatccatacaatgaaatacagccggtcgaccttgtatgtcacgagcaattagaagattcagacaatgaaacagatgaacccgaccatgtagttaatcaccaacaacaactactagccagacgggaagaaccacagcgtcacaaaatacagtgtatgtgttgtaagtgtaatactacactgcacttagtagtagaagcctcacaagagaacctgcgatctctactgcagctgtttatggagacactgtcatttgtgtgtccctggtgtgcatcgggaacccagtaacctgcaatggccaattgtgaaggtacagatggggatgggtcgggatgtaacggatggttcctagtacaggcaatagtagataaacaaacgggcgacactgtgtcagaggacgaggacgaaaatgcaacagatacaggttcagacttggcagactttattgatgatactacagatatttgtgtacaggcagagcgcgagacagcacaggtactgtataatatgcaagaggcccaaagggatgcacaatcagtgcgtgccttaaaacgaaagtatggagggagcaatctaaataaaagtccttgtgcaaaaccgccaggcgtacatagggaacaaagggtaacactacaagagctcccggtaaacatatgcaataaacaggcaagaacaaacgtgtattcagtaccagacagcggctatggcaatatggaagtggaaacagctgaagtggaggtaactgtagtaaataatacaaatggggaagaggaaggggaaaatggcggggaaaatggcggcagcatacgggaggagtgcagtagtgtagacagtgctattgatagtgagaatcaagatccacagtcacctactgcacagctaaaaacagtattacaggctaataaccaaaaagccatactactatcacaatttaaacacacatatggattagcatttaacgacctggtacgtacatttaaaagtgataaaaccatatgtactgactgggtagcagcaatatgtggagtaaatcccaccatagcagaaggctttaaaacactaattcagccatatgcgttatatacacatatacagtgtttggataccaaatatggagtgtatatactactattaattagatataaatgtggaaaaaacaggataacagtaggcaaaggattaagtaaattattacatgtgccagaaagttgtatgctaattgaaccacctaaattgcgtagccctgttgcagcactgtattggtatagaactggaatgtctaatataagtgaagtgtcaggtactacgccagaatggatacagcgattaacagtaatacagcatggaatagatgacagtgtatttgacctgtctgatatggtacaatgggcatttgataatgatgtaacagaagacagtgacatagcatatggatatgcattattagcagatagtaatagtaatgctgcagcatttttaaaaagtaactgccaggcaaaatatgtacgcgactgtgctacaatgtgcagacattataaaagggcacaaaaaaaacaaatgactatggcgcaatggattaggtttagatgtgataaatgtgacgatgggggcgactggcgaccaatagtgcaatttctaaggtatcaaggggtagaatttataacctttttgtgtgcatttaaggagtttttaaagggcaccccaaagaaaaattgcatagtaatacagggaccaccaaacacaggcaagtcatacttttgtatgagtttaatgcactttttacaaggtacagtaatttcatatgtaaattccactagtcatttttggttagagccacttgcagatgcaaaggtagcaatgttggatgatgccacaggcacatgctggtcatatttcgatacgtatatgagaaatgcattagatggaaatcctataagccttgacagaaaacatagacatttaatacaaattaagtgtccacccatattaataacatccaataccaatcctgtagaggaaaataggtggccatacctaactagcagactaacagtgtttacatttcctaatgcattcccatttgaccaaaacaggaatccagtgtacacaatcaataataaaaactggaaaagttttttccaaaagacttggtgcaaattagacttgcagcaggacgaggatgaaggagacaatgatggaaacactatcccaacgtttaaatgcgttacaggagaaaatactagaacattatgaacaggacagtaaactaatatatgatcaaatcaattattggaaatatgtgcgactggaaaatgcaatattttatgcagcacgggaacgtggcatgcatactatagaccaccaggtggtgccaccaggcactacttcaaaagcaaaagcatatcaagctattgaactgcagatggccctagagagccttgcacaaactgactttaataaagaggagtggacattaaaggacacaagtaatgaaatgtggcagacaaagccaaaacaatgttttaaaaaaaaaggtgttacagtggaggtgtggtacgatggaaacaaggacaattctatgcattatgtagtgtggggagcaatatattataaaacacatacagacacgtggtgtaaaacagaagggtatgtggattactggggtatatattatgtgcacgagcagcataagacatattatgaagtgtttaagcaggatgcacaaatgtatgggactagcggaaaatgggaagtgcattgtaatggcaacataattcattgtcctgactctatgtacagtaccagtgacgacacagtacccactactgagcttactgcagaactacaacacaccaccccggcccataccgccgcaacaaccccatgcaccaaaaaaactaagtcggcgccgtcttgcaagtgtggagtctccagaccctcagaaacagacggagtgttcgtggaccttgttacaagtaaaggctgcaacaaacgacggcaccagtgttgtggtgacactacacctatagtgcatttaaaaggtgacaaaaatggtttaaagtgtcttaggtatcgattgcgaaaatttaattcattgtatgaaaatatttcatgtacttggcattggatagggggcaagggaagtaaacatacaggtatactaactgtaacatatactactgaagcacaacgccaaaaatttttggaaactgttagaattccacctagtgtacatgtatctgtgggatatatgacattgtaacagcacatgctgtatgtatattgtatacatatcaatgattgcattggtgtttttggtgtggtttgctgtatgcttatatatatgttgcagtgtcccgcttttgccgtctgtgcatttgtgtgcgtatatgtggctacttttatttgtgtttattgttgtacataccacaccattgcaaatgttttgtatatatttactattttttatattgcctatgtggtttttacacatcctttcagtatatgcttaagttgtgttgctgcatagtgtattgtacattacttgtttttacatttatattgtaccaataaacatggtttctagccgtgcgtccaggcgtaagcgtgcatctgcaacagacatatataaaacctgcaagcaatcaggcacatgtccgcctgatgttgttaataaggtggagggtaccacactggctgataggtttttacaatgggctagtttaggtatttttttgggtggtttgggaatcggtacgggtactggtactgggggccgcacagggtacattcctttggggggtaggcctagtacagttgtagatgttacccctgcacgtcctcctgtggttatagaacctgtaggacctacagaaccttctattgttcagttggtagaggaatctagtgttgtttcctctggtacacccatccctacttttacaggcacatctgggtttgaaattacatcttctgcaaccacaacacctgctgtattagatattacccctgcttctgggtctgttcaaattagtaccactagttataccaatcctgcatttgctgatccatcgttaattgaggttccacaaacaggtgaggtgtcaggcaatatatttgttactactccaacatctggaacacatggatatgaagaaattcctatgcaggtttttgcctcacatggaacaggcacagaacctattagtagtactcctgttcctggtgttagtcgtgtggcaggcccacgtttatatagtagggcctatcatcaggttcgtgttaataattttgattttgtaacccgcccttcatcttttgtaacatttgacaatccagcttttgagcctggtgatacatccttaacatttgaacctgctgacacagctcctgatccagattttctggacattgttcgtttacatcggcctgctttaacctcacgacgcggaacagtacgctttagtaggcttggtaaaaaggccacaatgtttacccggcggggtacacaaattggggcacaggttcattattatcatgatattagtaacattactgcaacagaagacattgagatgcaacctttacttacctctgaatctacagatggtttatatgatatatatgcagatgcagatatagataatgcaatgttacatactacttctcatacaggttctacaggacctaggtcccatctttcatttccttctataccttctacagtgtctacaaaatatagtaatacaaccattccatttactacttcttgggacatacctgtaaccactggccctgacatagttttacctactgcatcccccaatttgccctttgtccctcctacatctatagataccacagttgcaatagccattcagggctccaattattatttattgcctttattatattattttctaaagaaacgtaaacgtattccctatttttttacagatggctttgtggcggtctagtgacaacacggtgtatttgccacccccttctgtggcgaaggttgtcaatacagatgattatgtaacacgtacaggcatatattattatgctggaagctctcgcttattaacagtagggcatccttattttaaggtacctgtaaatggtggccgcaagcaggaaatacctaaggtgtctgcatatcagtatagggtatttagggtatccctacctgatcctaataagtttggccttccggatccttccctttataatcctgacacacaacgcctggtatgggcctgtataggtgtggaaattggtagaggccagccattgggcgttggcgttagtggacatcctttatataatagattggatgatactgaaaattctcatttttcctctgctgttagtacacaggacagtagggacaatgtgtctgtggactataagcaaacacagttatgtattataggctgtgttcctgctatgggagagcactgggctaagggcaaggcctgtaagtccactcaacagggcgattgtccaccattagaattagttaatactgcaattgaggatggcgatatgatagatacaggctatggtgccatggactttcgtacattgcaggaaaccaaaagtgaggtaccactagatatttgccaatccgtgtgtaaatatcctgattatttgcagatgtctgctgatgtatatggggacagtatgtttttttgtttgcgcaaggaacagttgtttgccaggcacttttggaatagaggtggcatggtgggcgacacaataccttcagagttatatattaaaggcacggatatacgtgagcgtcctggtactcatgtatattccccttccccaagtggctctatggtctcttctgattcccagttgtttaataagccctattggttgcataaggcccagggacacaataatggcatttgttggcataaccagttgtttattactgtggtggacactacacgtagtactaattttacattgtctgcctgcaccgaaacggccatacctgctgtatatagccctacaaagtttaaggaatatactaggcatgtggaggaatatgatttacaatttatatttcaattgtgtactatcacattaactgctgacgttatggcctacatccatactatgaatcctgcaattttggacaattggaatataggagttacccctccaccatctgcaagcttggtggacacgtataggtatttacaatcagcagctatagcatgtcaaaaggatgctcctacacctgaaaaaaaggatccctatgacgatttaaaattttggaatgttgatttaaaggaaaagtttagtacagaactagatcagtttcctttggggcgcaaatttttactacaggtaggggctcgcagacgtcctactataggccctcgcaaacgccctgcgtcagctaaatcgtcttcctcagcctctaaacacaaacggaaacgtgtgtccaagtaatgtatgtatgttgtatgctgtgtattattgtactattacatatttgtgtttttatgttgtatgcttgcacactgtttacatatttgtgtttgtatgttgtatgcttgcacactgtactgtatatgtttgtcctggtacatatttgtggttgtatgtgtatatgttgcgtgctatgtgtatgttttagaagtatgtgtgtatgtatgtttttgttaataaagtatgtatggaggtttcatttgtggttgcaccctgtgactaaggtgttgtccctgttttacatataataggagtgtgattaccaacatttcctacataattttatgccctaccctaaggtgtgtgtataccatttgtagtttatacatttatattttatagtgggttacctgtatacagcaacggccattttgtgtgaaaccgttttcggttgcatttggctttgtaccatcagttacccttataaaccttttgtatcagcaaaaacatgtcctgtaacctaagttcacctacatacttggcactactaacagttttagtggcgcacctacacttagtcatcatcctgtccaggtgcactacaacaatgctttggcaaccttatgcacctccaccctgtctaataaagtgcttttaggcatgtattttacctgtttttacttacctaagagcatagttggcctgtataacagcttttacatccaagaatgtgtcgtttggtgcaagttatattttgtgactaatatttttacagacctgtgtgcaaccgaaataggttgggcagacattcctatactttta

SEQ ID NO: 42 - DNA, 8017 bp, Human papillomavirus type 71
ttgttctacttcttactcattattataaattataatgtttgtataagaaatataggtgtaaccgaaaacggtgtaaccgaaatgggtgcatatataaagcaatgcttggttcagcagatttagctatgtccagcggggacgcataccccaccaacctcttcagactgtgtaaccagtacgacgtggacctgcaggacctgaacctaacctgcatattctgcagaacaattaacagacgtggaagtcgtggccttgcatataaggagctgaaagttgtgtggagaagtggttttccgtttgctgcatgtgcctgctgtttggaaatagctggaaaactaaggcaacttagatattggcaattttcaggctttgcaaacacagtggaattagacaccggaacgccagttacagagcaactaatacggtgctacgtgtgtcacaagccattgtgtagtgtggaaaaagaaagaataattacagaaggcaggcgatttcataaaatagcaggccattggcgcggtgcttgcctacagtgttggaaaccatgcgaggccaacaatgtaccttaaagacattgtcctgcagctacagccagaggttgttgacctgtattgtcacgagcaatttgccagctcagacgaggaagataatagggtggacggtgagcaacccacagaaccagcacagcaggcatatagggtggtttcatactgtggtaggtgctgtcgtgcagttaggcttgtggtggaaagcgacgaagcagacataagagcgcttcaacagctgttactgggcacactgacaatagtgtgtcccatctgcgtgtagctgccatggccgactgtgaaggtacaggtactgatgatgatgggggcgaagcgggaacaggcgcgggagggtggttttttgtagaagctattgtggacagatgtaccggcccacagccatccagtgatgaggatgaggatgacaatgatactggggaagatatggtggattttataaatgacaggcatgcaggggacggacaggaagtggcagcagaggtgtacagacagcaagaagcattagatgacgaggcaattgtgcagcccctaaaacgaaagtttcttgcaagtcctttgtctgcaggggtgtgtgtagacaaagagttaagcccgcggctagatgctatatccataggcagggaatcccaaaaagcaaaacgaaggttatttgaactacaggacagtgggtatggcaatacgcaagtggatactgaagcggcaggaaaccaggtaccaagggacgggacgccaggggggctgcacacagaacaggaggaggagcgtcaggggggggatggggcggcaggcatagacagtacaccagcacacacaggaacaaatacagtgttggctttgttaaactccagtaatcgaagggcaacactgctaggtaagtttaaagacttatatgggttatcatatatggaattggtacggcaatttaaaagtaataaaacaacatgtttggactgggtagtatgtgcgtttggtgtgtattgcacggttgcggagggtgtaaaaaccttgatacagcaacactgtgaatacgcacacatacaacaacaaacatgttcctggggagtggttatattaatgctgttgcgatataagtgtgctaaaaacagagataccgtggcaaagggattaagcatgttattaaatataccagaaacaaacatgctaatagaaccaccaaaaataagaagtacgcctgctgcattatattggtttagggcgagcatgggaaacgcaagtgacatattcggggaaacgccagaatggatagttagacaaactgtggtaggacacagcatggaggaatgccagtttcagttatcagtaatggtgcaatgggcatatgaccatgatataacagatgaaagtatattggcatatgaatatgcccgtctggctgatgtagatagtaatgcagcagcctttttagcaagcaattgtcaagccaaatatgtgaaagatgcatgcacaatgtgtagacattataaacgagcagagcaggcacaaatgtctatgtcacaatggatatcatttagaagtgctaaaataacagaagaaggggattggcgaacaatagtaaaatatttaagacaccaggatatagaatttattacatttattatagcattaaaaaattttttaaagggtataccaaagaaaagctgtttagtattttatgggcctgcagacactggcaaatcctatttttgcatgagcctattacggtttttgggtggggttgtcatttcctatgccaattccagcagccatttttggttgcagccgttagctgatgcaaaattaggactaatagatgatgtaacccctaattgctggagctatatagatgtatatctaagaaatgcattagacggtaatcaaatatgtatagatagaaaacacaggccattactgcagttaaagtgtcccccattgttaataacaacaaataccaatccgttagaggaggaacgatggaagtttttacgtagtagactgcagctgtttacatttaaaaatgcatttcctttaaattcaaaaggggaccctatgtatccactaaatgatgcaaactggaaatgcttttttcaaaggttgtgggctcggttagacttacacgagcaggacgagcaggaggacaatggagacactggccagccgtttagatgcgtgccaggagacgttactagaactgtatgaaaaagatagtgaccagctacaggaccaaattaaacactggcaacacgtgcgatgggaaaatgtgttgttatttaaggcaagggaagcaggaattactcatcttgcccaccaggtggtgcctgtgcttggtattgctaaagccaaagcttgtaaagcaattgaaattcagttggcattaaagacattacttaacagtccctatagcaacgaacgatggacattgcgtgacacgagccaggaaatgtgggacgcagtgcctaagcaatgctggaaaaaaaaaggctacactgtagaagtgcgatacgattgcaaagaggaaaagacaatgtgttacacatgttggagggaaatatatgtgcaaaacagtacaaatgagacatgggaaaaagtgtgtggcctggtggaccatgcgggcatatactatttacacgatgggatacgtgtagactgtgtattattctccaaggaagcagtaatatatggggacacaggcatctgggaagtacatgtgggttcaagggtgatttatgatgcattcgactcctctgtgtctagcacccaggacaccgagcaagaccaagtacccactattaaacctactgaccacggacccgactcgcacccccaacaggcctccaccaccacccaagtgctgggcaccaacgaaacccaagtgtcgaccccgccatttaagcgacagcgactcggagacagacagcggacccttgagcagcccgattctacaaaagcaccacagcagctggcacgtgtcaaccttaggacccagtgtgacactgacggcgcacacgagcacgggaggacacgtgactgtaacagtgcacctgtaatacaccttagaggtgaagccaataaactaaagtgtttaaggtataggttgcaaaaacataaatctgtactgtttgccaaagcatcctccacgtggcattgggccactggcacagaggacaatacatgtaaaacaacatttgtaacattgtggcatgatagtgtggaacagcgggcacaatttctagccactgtacatattcctaagggcatagaggccttaccaggatatatgtcattgtttgcataatctttgtaaatattgtatatattgtatctattgtatagacgcggaacgttaagggtacacacctacctgtagtgctggagccctttctatgctgggtgtctgcatggacctatgcactactactactaattagcttttggctgtctattttatcttctcttactgcctttttaattttttttgttactgtgtttcttgggtttctagcactatatatacaggcagcagcgtcccttacctaactgtgacttgtgactaccacacaaccagccaatactgctactacgtgtacataacctatccatttgtgttatagattgcatatatgtatcctgttgtggtaaaggattcccaaggcggacattatgatattgtggtgtggggccctgatgatgtagatgtattgtttgtgtttttagtgttggtgtgtcttatgttgcttctgtttttgttacggttgatgcagtaggtacccccccttttgtattgccctgtttatacatatacatatacatattgtttttatttggtttttgtttttgtttttttgtgtgtgcctgtgtgtgtaaataaacacatttacaatgccacgtgcacggcgtcgcaaacgtgcttcagttacacagctatatcagtcctgtaagctaacaggcacatgtccccctgatgttattaataaggtggagcacaataccttggctgataaaatattacgctggggtagtttaggaatatttttgggaggtttgggcattggcacagggtctggcaccggtgggcgcacaggctatattcccattggtacacgtcctcctactgttgtggatgtaggacctcctgcacgcccccctgtggttatagaaacagtaggggcctctgatccatctattgtgtctttggtagaggattctagtattatagaagcaggagcaccatatcctaactttactggcacaggtgggtttgaggtcactacagcatccactactactcctgctgtgttagacattactccaggtaacactgtgcaggttagtagcagtagttttactaacccatcctttactgaacctgccttagtggagccccctcaaacaggtgaggtttcgggacatattttggttagtacctctacatctggcacccatggctatgaggaaatacccatgcaaacatttgcgtcggagggaacaggcaatgaacctataagtagtacacctattcctggggtacgcaggttagcaggccctcgcctgtatagtagggcctatcagcaggtgcgggtggatgaatccacatttcttcgccaccctgcatctatggttacatatgacaaccctgtgtatgacccagaggaaactataatatttgaacatcctagcatacaccaggctcctgatccagcatttatggatattgtggccttgcacaggccggcccttactgcccgtaaaggtacggtacgtttcagtcgtttaggacaaaaatctacccttcgcacccgtagtggtaaacaaataggggcgcgggtacatttttatcatgacattagccctatacaacccaccgaacacttagaactgcagccactagggcgggccttacaacaagaacctattgacacattatatgacatatatctgacacagattattccaatgatactgtcattcaacctacttctgtgtccagcaggcctacacctactactatacccctctgtaactgccacatcagccgtgtctgcctctcgcacacaaaatgttacagcacctttgtctgcaggagcagatgttccagtgtttgatggccctgacattgatttttccacctcccatgccactactcctactcctgtagtgccgtccattgcacctcccagttcttttattgtgtatggaactgaggtattatttaatgcctagttatatattttttcctaaaaaactaaacgtgtccactatttttttgcagatggctttgtggcggcctagtgacagcaaggtatacctgcctcctgccccccgtatccaagttctcagcaccgacgactatgttaccagaacaaaactattttattatgctggtagttctagattacttactgttggccatccatattttcctattcgccaggcaagtggtaaaaatcgtatagttgtccccaaagtgtctggataccaatatagagtgtttcgtgtgcggctacccgacccaaataaatttggactacctgatgcttcattatacaatcccgatacccagcgcttagtgtgggcttgtaagggtcttgaggtaggccgcggacagcctttaggaataggtgttagtggccatccattgtttaacaagcttaatgacactgaaaatgccacgctgtttgatgttaatcctggtgaggatactcgggataatgtttctatggattataaacaaacacaactatgtattattggttgcaagcctcccttaggtgaacattgggcaaaaggtactccatgcagtggcgcttcagctgccgctggtagttgccccccacttgaacttgccagtactgttatacaggatggtgatatggtagacacaggttttggggcaatggattttgcagccctgcaaacaaataggtctgacgttcccttggatattgttactacaacatgtaaatatcagattatttcgaatggctgcagagccattggtgatcgcatgtttttcttgcgccgagagcaatgttttaagacattttataataggcaggcacacctaggcagggttcctgatgactattatttaaaggttcaccttctacctttcgtgcttcccctacaagctctctttatgcatccacacctagtgggtccatggttacctcagagtcacagttgtttaacaagccttactggctacaacgtgcacagggcacaaacaatggcatttgttgggcaatctgctttttgtaacagttgtgacacatcacgtagtacaaatatgtccatctgtgctaccaaaactgttgagtctacatataaagcctctagtttcatggaatatttgagacatggagaagaatttgatttgcaatttatatttcaactatgtgttattaatttaacagctgaaattatggcctacttacatggcatggatgctacattactggaggactggaattttggttccttaccacctcctactgctagtcttggtgatacctaccgctttttacagtctcaggccataacctgtcagaaaaacagtcctcctcctgcagaaaaaaaggacccctatgcagatcttacattttgggaggtggatttaaaggagcggttttcactagaattggatcagtttccattggggcgcaagtttttgctgcaaagtggcacccgctcgcggcctactgcattgtcccgtaaaagggttgcagcatctaccacatccaccgcccccaaacgtaaacgtgttaaacgctcccggtagtagtggtgtgtgtgtgtgtgagtatgtatgtgtatgtgtgtgtgtgtgtgtgtgtgtgtgtgtgtgtgcatgtttatatatgtatatgtgtttgttgtgtatattgtatgttgttgtgtacgtgtgtatatactgtgcgaccccctggcttcctgtatgcatgtttgtgttgttaataaatgcgtgtcatgtatgtgtgttatttggttgcacccctgtgagtaagtgtgcaagcagatataaccccccctgtccggtgacgccttactgaccagtgaccatgccctgcctttggcccctggttatatttaaggaacgaaccgttttcggttgcctaaaatggccgccgttttggctggcggccgccgttttggcgggctactatacaatgggtaatccttgtattgcttcatatcctttccaacacaggtgtgcataccatcataaggtgtgcctggcagttatttggcacactataaatgcatgttataattaactttaatacatgtgttactcaccgtgcaatacccattgtttggggcatatagttgtgctgactatgttcgcctaagtacgtttttggcaacagcagtgtagtttctgtccaagaatgtgtctgctaacttttataatgtacttagcaacatggtttatacacacctaatccggttgttcc

SEQ ID NO: 43 - DNA, 7988 bp, Human papillomavirus type 72
attactaacaataatacatgtaaaaaagtaagacaagaccgaaaacggtccgaccgacataggtacatatataagggaactgtgaactcagcaaatcagcaatgcctatgggactgcacaatccaactaatatttggttgctgtgcaaggaaattgaggtggacctagaagatttacggattacctgcatattttgcaaaaatgaattaacaacagaagaattgctggcgattgcaataaaggagctgcagattgtgtggcgggacaactggccatttggagtctgcgcaccatgccttgcaagagcaactaaagtgagggagctacgatactggacgtattcgggctacggacccactgtggaacaggaaacaggcaaatcattagcagaactatatataaggtgccatgcatgctgcaaacccctaagctgtcaggaaaaggaatatcaggtgcagacaggaatccacttccacaagataagcggactgtggacgggaaggtgctgccagtgtagaggggcatgcacggccaggtggcaaccataaaggacattgtccttcaggaacttcctgatgtggttgacctacactgcaatgagcagttactagacagctcagagtcagagtcagaggatgagagggacggtgttggtgtgcaggagcaacttgtagaacaagcacagcaggcctacggggtggttactacctgtggcaggtgctaccgtccagttaggctggtggtggagtgcagagacgcagacgtgaaggcgctacaacaactactgctggacaatttgtccatagtgtgtcctcgctgcgcataagggacatggccaactgcgaaggtactgaacggggggatggggacgaggatgcgaatcgcgcgggcggatggtttttggttgaggccatagtggagcaaaccacagggtaccaagagtccagtgatgaggacgaaaacagtgaggacaggggagaagatctggtagactttatagacacaagatccttaggggatgggcaggaagtgccgttagatttgttcgtgcaacaaaatgcacgggatgacgctgcaaccgtgcaggccctaaaacgaaagtatacatgtagcccagcaagcagctcgtgtgtgtctttggtggacagtgagttaagtccccgactggacgccataagcataaaccggggacacgacagggctagaagaaggctgtttgaccaagacagtggctatggccatacgcaggtggatattggagcaccagaaagccaggtatcggggggtacacagcatacaaaggggggaggcggcgccgttcaggaagcggaagaggagcgtgtggggggggatggtgaggcgcagtgtagtgcacagacacagcaaacgccagagagagcagcagacgtactagaaatatttaaggttagtaatttgcgtgtcacattactgcataaatttaaagagctatttggactagcatatggggatctggtaagacaatttaaaagcgataaatcaatatgtggggattgggtagtatgtgcatttggggtatatcatgcagtggcagaggcagtaaagacgttaatacaacccatatgtctgtatgcacatatacaaatacagacgtgtcaatgggggatggtaattttaatgctggtgcggtataaatgtggcaagagtagggagacagtggcacacagcatgagcacgctgctaaatatacctgaaaagcaaatgcttattgaaccaccaaaaattagaagtggaccatgtgccctatactggtatagaacagcaatgggaaatggcagcgaggtgtacggggaaaccccagaatggatagtaagacaaacagtagtggggcatgcaatgcaagagacacagtttagcctttctaccttagtacagtgggcatatgacaatgacataacagatgagagcgagctagcatatgactacgcaatgctaggtaatgaggacccaaatgcagcagcatttttagcaagcaactgccaggcaaagtatattaaggatgcaattacaatgtgcaaacattataaacgtgcagaacaggcacgaatgtctatgacacagtggatagcacatagggggcgcaaggtggcagattcaggtgactgagagaaatagtaaaatatttaagatatcaaagggttgaatttgtaacatttatgggagcattaaagctatttttaaaaggggtaccaaaaaaaagctgtatggtattctatgggccaagtgacaccggaaagtcattgttttgtatgagtttacttaagtatttagggggagcagtaatttcatatgtaaattcaggaagccatttttggttatcaccactggtagacgccaaagtagggttgttagatgatgcaacataccagtgctggcaatatatagatacatacctacgaacagtgttagatggaaatgctataagcatagatagaaaacatagaaatttaacacagttgaagtgtccaccacttatgataacaacaaatataaatccattggaagaccaggcatttaaatatttgcacagtagaatagtgttgtttaaatttatgcataagtgcccattaaaaagcaacggtgatcccgtatataccctaaataatgaaaattggaaatcgtttttccaaaggtcctgggcacgtatagagggacctgacgaacaggaggaggaggaggatgaggatggaagcactagccgaccgtttagatgcgtgccaggagaaattgctagacctttatgaaaaagatagcgacaagcttgaggaccaaatattgcattggcactatgtgcgtctggaacatgcaatgttatttaaggcacgacaagcaggacttacccatgtaggccaccaggtggtaccaacacttagtgttacaaaaggcaaagcacatcaggcaattgaagtgcacctgtcactgcaagggttgcaaaacagtgcgtatgcgcaagaaccatggacattacagaacacctcactggaaatgtggaatgcacacccacaacggtgttggaagaaaaaaggacgcacaataacagttaaatttgattgcgaggacctaaaagcagtggagtatgtgagctgggggtgtatttatgtgcaaagtacagaggacgaacagtggtataaagtacaaggacatgtgtcatatcatgggctatattatgaatttcagggtcagaaacagtactatgtaacatttggacacgaagccagaaaatatggggacacaaacacatgggaggtacatgtgggaagtacagtgatttatgaaccctgcgcctctgtatctagcacccaggacaccgtgcgagaagtacccactgttgaaactgttgggcgactgccagacgccaccaaatccaccgccaccgccacgtgcgtgggccccgcccagacatcctcctcagtgcagacgccgccttgtaagcgacagcgactccacagagacggattgcagcagcagcccgactctacggaaagagacatctgcaggcaacggcgtgacagtgctgaccagtgggtcaaccgtgacagtgactgcacacaacaagcaagggacatctgtaacagtcacggtgcacctataatacatttaaaaggtgaaccaaataagttaaagtgttttcggtataggcttcagcagtcagtgcctaacttgtttttaaaagcatcctctacatggcattgggcctgtgggggtgacacaacaaaatgtgcatttgtaacactgtggtatgtggatactgaccaacggacacaatttttaagtcgtgtgaacattccaaaggggatacaagccactgctggctatatgtcaatgtgtatataatgtttgttgcgatggcaaccagtgtatagaaccacacctgcaacattatgtaaggcagaagcaatcctggatatacttgtgtgtttgatatctgggtggtgtactgtgctgttgctgcttattattttctggctttcctatctttctgcactaagtgcttttttggtgtttgtgtgtgttatatatctaggattgttttgtatatatatgcaggtgatgtggtacataggtgacttataatccacccagccattacatgctgctattgtgtaaatagtgttccttgtgtatcttgtatgtaatatgtatcctgttgtagtgggcaatacggatgggggtgcattaattgtactacgagacgataattgtggattgtggttcttcttgtgtatgttaataatcattgtagtgttgctatataggttgctacactgatcccttccttttgtgtattcccacctcctttttatttttgttttgttttgtttttgttttttatttttttgcatttttataataaacattatctgccaaaatgacccaagctgtaaggcgtcgcaaacgtgcctctgcaacggacctgtatcgcacatgcaaacaggcgggtacctgccctcctgatgttataccaaaggtggagggtgacacccttgctgataggttcctgaagtgggccagtttaggggtgttctttggtgggttaggcataggcacgggttcaggcaccggtgggcgcactggctatgtgcctataggtactcgccctcccactgttgtggatataggccctacaacacgcccgcctgttgttattgagcccgtgggggccgcagacccttccatagtcacccttgtggaagaatccagcgttgtggaagccggtgccaccgttcccacttttactgggtctggtggctttgaggttaccacgtcctcaactactacccctgctgttttagacattacaccctctggagcgtctgtccaagttagcagtagtagctttacaaatcccttatttactgaaccgtccattattgaacctccacaggccggggacctttcaggccatgtattcactagcacacccacatctgggtcgcatagctttgaggaaatacccatgcacacatttgcaactcatagcagtactagcacagacccctttagtagtacccctttgcctggtgttcgtcgccttgcacagccccgcttaggattgtatagcaaggctaatcaacaggttagggttactaaccctgcctttttgtctcgaccccagtctcttgttacttatgacaaccctgtgtatgatccagaggaaactattatttttgagcatcctagtatatatacccctcctgatcctgactttttggatattatttccttacataggcctgcccttacagcccgccagggtacagtacgggtcagccggttgggtcaacgtgctaccttgcgtacacgtagtggcaaacgcattggcgctcgggtacacttttatcaggacattagccccatttcatctgatactattgaaatgcaatccttggcctcctctacgcagccagacataacatatgacatttatgctgaccctgatttaggggaacccccgccgcgtgcttctgtgtcttctacatcattgcacagcccgtccctgtctgcagcgtctgctgtttctgccaagtatgacaatgtaacagttcccttgtccttagggccacacatccctgcctcctctggccctgacattgatttgtcctttgctcctgcccctgtacctacaatgcctcttgtaccctctacgcatccacattctatttatgttgagggctttgatttttatttgttgcctgcatatatcttttttcctaaacgtcgtaaacgtgtgccctattcttttgcagatggctttgtggcggcctggtgacggcaaggtatacctgcctcccaatcctgtttctaaggttctcagtactgatcgctatgtccaacgcaccaacctctattattatggtggcagttctcgtctactaactgtaggacatccttactgtgccatacctctcaacggacagggcaaaaaaaacaccattcctaaggtttcggggtatcaatacagggtgtttagagtaaaacttcctgatcccaataaatttgctttgcctgatggcacactttacaatccagatactgaacggctggtatgggcctgtcgtggcattgaggttggtaggggccagccccttggtgttggcactagcggtcaccccttgtataatcgcttggatgacactgaaaacacttccttacttgtggctgacaattctgacagtcgggacaatgtatctgttgactacaaacagacccaattgcttattatagggtgcaagcctcccattggtgagcattggaccaagggcactccttgtgcaggctctaattctcagccaactgactgcccccctttagaatttacaaattccactatacaggatggtgacatggtggaaacaggctatggtgccatagattttgctacccttcaggaaaataaatcagaagtgcctttggatatttgcaccaccacctgcaaatatcctgactatttgcaaatggctgctgaaccatatggtgattgtatgtttttttgtcttcgcagggaacaaatgtttgcacgccatttttttaataggcagggcacaatgggtgaggcactaccagccagtttatatcttaaaggtgcctcgggtagcgacagggtgacacctggtagttatatttattctcccacccccagcggctctatggtgtcctctgatgcacaattatttaataagccctattggctacagcgcgcccagggtcacaacaatggcatctgttggtttaatgagctttttgtgacagttgtagatactactcgcagtactaatgtaactatttgtactgccacagcgtcctctgtatcagaatatacagcttctaattttcgtgagtatcttcgccacactgaggaatttgatttgcagtttatatttcaactgtgtaaaattcacttaactcctgaaattatggcctacttgcacaatatgaataaggccttattggatgactggaattttggtgtggtgcctcctccttctaccagtttggatgatacctataggtttttgcagtctcgtgccattacctgtcaaaagggggctgccacccctcctcctaaagaagatccatatgctaacttatccttttggactgtggatttaaaggacaaattttccactgacttggatcagtttcctttagggcgcaagtttctgttacaggttggttctagggctgtttcagtgtcacgcaaacgtgctgccccaccaagctctacctcgacccccgcccctactaaacgtaaaaagcgcaaaaagtaacatgtcatactgtttgtgtggtgtatgtgtgtatgtgtgcaatgcatgcatgtgtgtttctgttgttgtttgtgtgtacatgtttgtactatgttatgttgttgtatgttttttgtatggcccctgcccccgtgttgtgtatgtatgtggaatgtgtgttatgtgttgtgcattaataaagcgtgtgtcatgtgtgtgtgtgtgtccggtgaaccctgtgagtaagtgtgtgtttgcacgttgtcctacttcctacactttgttttgtgtcacctttgtatgccctttactgtactccattttatattttctccattttgtattcgcgaccgttttcggtctcccgccttttcggtcgtggcgccgtgccactgtacatagaaactatgcattgtgctttcctcccacatcctgtttcaacaaaccttatccacatctgggtgtgcctgacaggtttctggcacatacattttccatagttatgtgtttcctgactcattttacaatagatatgcttttaggcacatattttatgctgactactttctcctaattgctgttttggctacctttctaggtgttgtagccaagtatgtgtcttgcaactatgggcaagccctttacaaacgtgttaaaacattctactccggtcgctcccctatgtctcatggttttatagtt

SEQ ID NO: 44 - DNA, 490 bp, Human papillomavirus type 26
ccgttgtatgccggcctgtaacataaacttacgccctagtggaaattgatccaaatcaatagaaaatttttcttttaaatctacatcccaaaatttaaatttttgaaaaggatcttcctttggcacaggaggggcgttacgctgacaggtagtagcagagtttttaataaacctataggcatcttccaaactagcagtgggaggtaaggttagtccaaaattccaatcctccaatatggaggcattcattaaatgtatgtaagccataacatctgttgtaagtgttattttacacaactgaaatataaattgtaattcatattcttcgccatgtcttataaattgtttataatcagatggtttaaatggagtggatgcagatgctgcagataatgtactaatggtaaggttagtactgcgggtggtatcaacacaggtaacaaacaattgattgccccaacagataccattattatgaccctgtgcacgt

SEQ ID NO: 45 - DNA, 1460 bp, Human papillomavirus type 33
gtctctaatgccatttgtagttcaattacttgaaatgctttggtctttgatgctaacaaagaaggcaccacctggtggcataaatgtgaaaatcccatttgtttggctgtatacaataaagcacactccatgcgtatcagtttccaatgttcaatttgtgatggtaaatcagttttatcagcttcgtaaagagctagcattttctcctgcactgcatttaaacgtgctgatatttcctccatggttttccttgtcctcttcctctattaaatctaatttgcaccacgtccttgagaaaaaggatttccaattttcatcatttattgcatacactgggttaccattttcatcaaatgggaatggatttttaaattcaaatactgttaatctactatgtaaatatggccatctagagtctgtgcctgcatttgtatttgaggtaagaagcagtggtggacattttaattgcactaatgccctatgtttcacatctattgaaatttcatttccatctaacgcatttctcatgtaatcatctatatatgtccaacttattggcgttacatcatctatcattcctatttttgcatctgataatggctgcaaccaaaagtgacttttagaatttacacatgatataacacacccttttaaaaactgtattaaactcattccaaaatatgactttcctgtatttgctggtccacaaattagcatacagcttttttttggtataccttttaaaaactttttaaatgcacctaaaaatgctgtaaattcaatgttttgatatcttaacaactgtactattggtctccaatttcctccatcatttgttttttcacatctactttgtatccattgtcctattgacattttacgtttttctgcttttttataatgtctacacattattccacagtcctttactatttttgcttgtgagttactttttaaaaatgcagcagcattactatttgaatctgcaagttgtgcataataatatgcaatgtcactatcgtccgttaactcgttatcatatgcccactgtaccatttcacttaaatcaaatatattatcattaaagctatgttgtaaaacagttagtctatctatccattcaggtgttgtaccttgtacatcactaatgtttgacattgctgttctaaaccaatacaatgcacatgtttggctccgtaattttggtggctctataaccatacatgtttcaggtattgataataaattactcattagttttgctactgttaacctgtttttgctacacctaaatctaattaacaataatattattattcctctatcgcaagttaaacattgtaaatgagtatacaaactatgctgtttaattaatacttttaaactttctgctactgatggactaattccatatcctgttatacaccaatctgtacagcttgttttatcacttttaaatg

SEQ ID NO: 46 - DNA, 1459 bp, Human papillomavirus type 33
gtctctaatgccatttgtagttcaattacttgaaatgctttggtctttgatgctaacaaagaaggcaccacctggtggcataaatgtgaaaatcccatttgtttggctgtataaaatatttccctccataatggatccgtttccaatgttcaatttgtgatggtaaatcagttttatcagcttcgtaaagatctagtattttctcctgcactgcatttaaacgtgctgatatttcctccatcgttttccttgtcctcttcctctattaaatctaatttgcaccacgtccttgagaaaaaggatttccaattttcatcatttattgcatacactgggttaccattttcatcaaatgggaatggatttttaaattcaaatactgttaatctactatgtaaatatggccatctagggtctgtgcctgcatttgtatttgaggtaagaagcagtggtggacattttaattgcactaatgccctatgtttcacatctattgaaatttcatttccatctaacgcatttctcatgtaatcatctatatatgtccaacttattggcgttacatcatctatcattcctatttttgcatctgataatggctgcaaccaaaagtgacttttcgaatttacacatgatataacacacccttttaaaaactgtattaaactcattccaaaatatgactttcctgtatttgctggtccacaaattagcatacagcttttttttggtataccttttaaaaactttttaaatgcacctaaaaatgctgtaaattcaatgttttgatatcttaacaactgtactattggtctccaatttcctccatcatttgttttttcacatctactttgtatccattgtcctattgacattttacgtttttctgcttttttataatgtctacacattattccacagtcctttactatttttgcttgtgagttactttttaaaaatgcagcagcattactatttgaatctgcaagttgtgcataataatatgcaatgtcactgtcgtccgttaactcgttatcgtatgcccactgtaccatttcacttaaatcaaatatattatcattaaagctatgttgtaaaacagttagtctatctatccattcaggtgttgtaccttgtacatcactaatgtttgacattgctgttctaaaccaatacaatgcacatgtttggctccgtaactttggtggctctataaccatacatgtttcaggtattgataataaattactcattagttttgctactgttaacctgtttttgctacacctaaatctaattaacaataatattattattcctctatcgcaagttaaacattgtaaatgagtatacaaactatgctgtttaattaatacttttaaactttctgctactgatggactaattccatatcctgttatacaccaatctgtacagcttgttttatcacttttaaatg

SEQ ID NO: 47 - DNA, 1692 bp, Human papillomavirus type 39
cagtagtgggtaccgatccgtcactggtactgcacatagagtcaggacaatgaattatgttgccattataatgcacttcccatttgccactagtcccatacctttccgcatcttgaataaacacttcatagtatacttttaggtgctcgttcatataatatataccccaatagtccacacacccttctgttttacaccatatgtctatattatttttataatatatagcaccccataatacatagttcatagcattacatttgtccccatcataccacacctccactgtagttccttgttttttaaaacattgttttggctgtgtatgccacagttcattactagtgtcttttaatgtccactcctctgtattgtattcagtttgtgcaacactttctagtgccatctgcagttcaatagcttgatatgctttacattttgaaatgtttatggttggcaccacctggtggtcaatagtatgcatgccacgttctcgtgctgcataaaatattgcattttccattcgcacacatttccaataattaatttgatcatatattgatttactgtcttgttcatagtattctagtattttgtcctgtaacacatttaaacgttgtgaaagtgttttcatcattgtctccttcatcctcgtcctgctgcaagtctaatctgcaccaagtcttttcaaaaaaacatttccagtttttatcattgattgtgtacactggattcctgttttggtcaaatggaaatgcattaggaaatttaaacactgttagcctactacgtaaatatggccacctatcgtcttccacaggattggtattggaggttattaataatggtggacatttcatttgtagtaaacttttatatttcctatctaaacttattgcatacccatctaatgcatttctcatataattatcgaaatatgaccagcaggtaccggttgcatcatctaacattgctagttttgcatctgcaagtggttctagccaaaagtggctggtggagtttacatatgaaataactgtgccctgtaaaaaatgcataaggctcatacaaaaatgtgactttcctgtattcgcaggtccatatataactatacagttttttttgggagtaccctttaaaaattcctttaatgcacataaaaaggatataaattctattccttgatatcttaagaattgtactatgggtctccagtccccgccttcatcacatttactacacctaaattttatccattgagacatggacatttgccttttttgtgctcgcttgtaatgtttacacattgttgcacaatcttttacatattttgcctggcagttactttttaaaaaggctgcagcattactgttacaatctgctaacattgcataattaaatgctatgtcactttcatcagtatattcattgtcaaatgcccattgtaccatgtccgataggtcaaatacactatcatctattccatgttgtataacagttaatcgttgtatccattctggcgtatcccctgttaccacactaatattggatatacctgtgcgataccaatatagtgctgctacagggctgcgcagtttaggaggctccagaagcatacaactttctggaacatgtaacaatgtacttaatccctttcctacagtaaccctattttttccacatgtatatctt

SEQ ID NO: 48 - DNA, 190 bp, Human papillomavirus type 39
ataccaccacgattccaaaaatgtcttgcaaacagttgttccctacgtaaacagaagaacatactgtccccatacacatctgcagacatttgcaaataatcaggatatttacaaatggattgacaaatatctaaaggcacctcacttttggtttcctgcaatgcaccaaagtccatagctccatagccag

SEQ ID NO: 49 - DNA, 1376 bp, Human papillomavirus type 52
taatagaaccaccaaaattacgaagtgctacctgtgcattatattggtatagaacaggtttgtctaatattagtgaggtatatggtaccaccccagaatggatagaacaacaaacagtattacagcatagctttgacaatagcatattcgattttggagaaatggtgcaatgggcatatgatcatgatataacagatgatagtgacatagcatataaatatgcacagttagcagatgtaaatagcaatgctgcagcattcctaaaaagcaattcgcaagcaaaaatagtaaaggactgtgcaaccatgtgtagacattataaacgggcagaaagaaaacatatgaatattggacaatggatacagtatagatgtgatagaatagatgatggtggagattggaggcctatagtaagatttttaagatatcaagacatagaatttacagcctttttagacgcatttaaaaaatttttaaaaggtatacctaaaaaaaattgtttagtattatatggacctgcaaacacaggaaaatcatattttggaatgagtttaattaggttcttaagtggatgtgtaatatcctatgtaaactcaaaaagccatttttggctacaaccattaacagatgcaaaagtgggtatgatagatgatgtaacacctatatgttggacatatatagatgattatatgagaaatgcactggatggaaatgatatatcagtagatgtaaagcatagagccttagtacaaataaaatgcccaccattaattttaacaacaaatacaaatgcaggaacagatcctaggtggccatatttacatagtagattggttgtgtttcatttcaaaaacccatttccatttgatgaaaatggcaatcctatatatgaaattaacaacgaaaattggaaatcctttttctcaaggacgtggtgcaaattagatttaatacaggaagaggacaaggaaaacgatggagtcgataccggcacgtttaaatgcagtgcaggaaaaaatactagatctatacgaagctgatagtaatgacctaaacgcacaaattgaacattggaaattgactcgaatggaatgtgttttgttttacaaagcaaaggaactgggaataactcatataggccaccaggtggtgccaccaatggcagtgtctaaggcaaaggcctgccaagctattgaactacaattggcattggaggcattaaacaaaacacaatatagcacagatggatggacattacaacaaacaagtctagaaatgtggcgtgcagaaccacaaaaatactttaaaaaacatgggtatacaataacagtgcaatacgataatgataaaacaatactatggattatacaaactgg

SEQ ID NO: 50 - DNA, 1961 bp, Human papillomavirus type 56
acgtggaggtggtggtggtggtcttgtgggtgttgtattcgttaacagtttcaacaggggatacgttgtatctacaggtactagacacagagtcaggacaataaatactctcattttccatatgtacttcccatatgtttttacacccaaattttttggcctcttgttcaaagtctgtgtagtatgttttgtggccatcatgtacataatatatacctctatagtctaccccagaacacactttttgccacccacaatctccattgtaatatatatatttccaggctacatattgcatacaattgtttttactaccatcaaaccatacttctatatgttgtccttcttttttaaagcattttttaggttcagtaagccatagttcctcgcatgtgtctcttaatgtccactcttcattgttatatattgttgtacttaatgattccagtgctatttgcacttctattgcactacatgcttttgctttacatacttgtaaacaaggcaccatctggtggtttagtacagtaatgtcattttctcttgctttatagtatagcacattttcatgtcgcacagctttccaatattctatatgatctgcaatacatctactatctttttcaaaacagtctagtattttgttctggcacgcatttaaacgttgggaaagcgtctccattgttttctttgtcctcgtcgttatccaaatttaatctggaccacgtccttgtaaagaaacatttccagtttacattacttaattcatatacaggattaccattattatctaatggaaatggattttgaaactgaaacactaacattctactgtgtaaatatcgtaatttagcatctagcataggatttatattggttgtaattagtaatggtggacattttatttgtactaattgtttatgttttctatctaaacttataggatttccatctaccaaattccttaaataatcgtctatatatttccaacatatttctgttgcatcatccaacaacccaagtttagcattgtctaatggctgcaaccaaaagtggctttgtgaattcacaaatgaaatgacagacccttgaaaaaactttataagactcatagcaaagcatgatttacctgtatttggcggtccacaaagtaccaaacagttatgtttaggtgttccttgtagaaataatttaaagtaacttagaaatgaaatgaaatcgaccccttgatatcttaaaaattgtacaatgggtttccaatcacccccttcatctgttttactacatatgtgctttatccactggcacatattcatttgttgctgttgtgcccttttataatgtctacacattattccacaatcctttacatattttgcctgcatattgctttttaaaaaggcttgtgcattgctgtctacatctgctaattgtgcatattgaaacgcaatttggctatcatctgttacttcattatcaaatgcccactgcaccattttagataattcaaattgactatcctgtaaactgtgttgcaattgtgtttgtctttgtatccattctggtgtgtctccatacacatcactaatatttgacattgctgttttataaaaatataaagctacagcaggacttcgtatttttggtggttgaattaacatttgctcctgtggtacatttaatattgagcttaatgcttttgcaattgtttttctgtttttgccacatgtatatctaattagcatcattactataaccccccatgtacatgttaaacattgcatatgataatacatacagtgtggttttattatagtttttagtgcctcggctaatgtttcattaacaccaaatatagcacatatccaatcattgcaacatgtactatcacttttaaacgtacgcaccaattctgaaaatggaataccatacacttctttaaatttataatataatttacc

SEQ ID NO: 51 - DNA, 210 bp, Human papillomavirus type 56
ttagctaatgggtcctgtttttctgttggtggctgttcccgttgacatgttatagctgtgcttctaacatatctatatttatcttctaggctggtggccactggcggggataacccaatattccagtcctccagtaggttagcattcatattatgtaaatatgccataacctctgcagacaaagtaattttgcataattgaaaaacaaat

SEQ ID NO: 52 - DNA, 1300 bp, Human papillomavirus type 58
ttgtgatgttaaatcatttttatcagcttcgtatatgtctaggattttgtcctgcactgcacttaaacgtgctgatatttcctccatcgttttccttgtcctcttcctctattaagcctaatttgcaccacgtccttgagaaaaaggatttccaattttcatcatttattttatacactggattaccatttgcatcaaatggaaatggattgttaaattcaaatactgttagtctactgtgcaaatatggccatcgtgaatctttgcctgcatttgtatttgaggtaattattaatggtggacattttaattgtactaatgccctatgttttacatctattgaaatgtcgttaccatctaatgcatttctcatataatcatctatatatgtccagcttatggctgttacatcatctatcatacctagtttagcatctgataatggctgcaaccaaaaatgacttttggaatttacatatgaaataatgcatccttttaaaaaatgtattaaactcattccaaaatatgatttccctgtatttgctgggccacacagtaacatacaacttttttttggtacaccttgtaaaaactgtttaaatgcaactaaaaatgctgtaaattcaatattttgatatcttaaaaattgtactattggtctccaattacctccatcatttgttttttcacacctactttgtatccattgtcccattgtcataccacgcttttctgctcttttataatgtctgcacataacgccacagtcttttactatttttgcttgtgcattgcttcttaaaaatgctgctgcattactattaacatctgctaactgtgcatatttatatgcaatgtcactatcatctgtaatgtcattatcatatgcccattgtatcatttcacttaaatcaaatatatcatcattaaagctatgctgtaacactgttaatctatctatccattctggtgttgtcccttgcacatcacttatatttgacattgctgttctaaaccaatataaggcacatgcttgacttcgtaattttggtggctcgataatcatacatgtttcaggaattgatagtaaattactcattaattttgccacagttaatctatttttgctacatttaaatctaattaacaataataatataattcctctgtcacacgttaaacattgtaggtgtgtatatatactgtgctgtttaattagtacttttaaactttctgctacggagggacttattccataccctgttatacaccaatctgtacagcttgttttatcactttt

SEQ ID NO: 53 - DNA, 1655 bp, Human papillomavirus type 66
ttttttaaaacagtttttgggctccgtgcgccacagttcatcacatgtatcacgtaatgtccactcttcatttttatatattgtgttacttattgcttccagtgccatttgtaattctattgcactacatgcttttgctttacacacttgtaaagagggcaccatctggtggtttagtacattaatgtcattttctcttgctttataatataatacatattcatgtcgtacagctttccaatagtttatatgatctataatgcatttactatctttttcataacagtctagtattttgttctggcacgcatctaaacgttgggatagagtctccattgttttctttgtcctcgtcgttatccaaatttaatctggaccatgtcctttcaaaaaaacatttccaatttacattactcaattcatacacaggattaccattgttatctaatggaaatggattttcaaacttaaacactgaaattctactgtgtagatatcctaattttgcatcttgcataggatttacattagttgtaataatgactggaggacattttatttgtactaattgtttatgtttcctatctaaacttatgggattcccatctaataaatttcttagataatcatctatatatctccaacacgtatctgttgcatcatccagcaaacctaatttggcattgtctagtggctgtaaccaaaagtggctttgtgaattaacaaatgaaatgactgacccttggaaaaaatttataaggctcatagcaaaacatgatttacctgtatttggtggtccacacagtaccaaacaattatgtttaggcgtgccttgtaaaaataatttaaaataacttaaaaatgaaatgaagtcgaccccttgatatcgtaaaaattgcacaatgggtttccaatcaccaagccaagcttaattcggcttcccttcatctactttactacatatatgctttatccactggcacatattcatttgctgttgctgtgcccttttataatgtctacacattattccacaatcctttacatattttgcttgcatattactttttaaaaatgcttgtgcattactatctatgtctgctagttgtgcatataaaaaggcaatttggctatcatctgttacgtcattatcaaatgcccactgtaccattttagacaattcaaattgattgtcttgtaaactgtgttgcaattgtgtctgtctttgtatccattctggtgtttccccatacacctcactaatatttgacattgctgttttataaaaatataatgccacagcaggacttcgtagttttggtggttgaattaacatttgctcttgtggtacatttaaaattgagcttagcgattttgtaattgtttttctgttttttccacatatatatctaattagcatcattacaattaccccccatgaacatgttaggcattgcatatgatagtacacacattgtggttttagtatagtttttaacgcttctgctaatgtttcattaacaccaaatattgcacatatccaatcgttacaacatgtactatcgcttttaaatgttcgcaccaactctgtatatggcactccatacacttctttaaatttaaaatgtaatcttccttgtacgttactactttta

SEQ ID NO: 54 - DNA, 320 bp, Human papillomavirus type 66
gattaccccagcatatgccattattatggccctgtgcacgttgcaaccaataaggtttattaaataattgggcctcagaggtaatcatggacccactaggagtagcaacatatacagaactgggaggagggtccctgccattgccacccttccaatacaaatctgtaggaatggcttccccaacattacctgccctattaaagtaatgtttggcaaacaattgttccctgcgtaagtaaaaccacatagaatccccataggcatctgcagacatttttagataatcaggatatttacatgtagattgtacaatgtccaat

SEQ ID NO: 55 - DNA, 1930 bp, Human papillomavirus type 68
gagtttgtttttttggtgcatggggcacctgcggtggtatgggtcgcggtggtgttctgtaggtcggcaacagattcagtagtggatacttttccgtcagtggtactgcacatagagtcaggacaatggattatgttgccattataatgcacgtcccattttccactagtcccatatagttgtgcatcctgcataaacctttcgtaataggttttttgttgttcatacatataatatacaccccagtaatccacacgcccttgggttttacaccatgtgtctgtactgtttttaaagtaaattgtaccccacactacataatgcattgagttactcttgtccccatcataccatacttccactgtaacaccatgttttttaaaacattgctttggctttgtatgccatagttcattacttgtgtcccttaatgtccactcctctgcactatatgcagttttagcaaggctctctagtgccatctgcagttcaatagcttgatatgctttagtttttgaaatgtttacaggcggcaccacctggtggtcaatattatgcataccacgttctcgtgctgcataatatattgcattttccagtcgcacacaattccaatagttaatatggtcctgtatacatttactgtcctgttcataatgttctaatattttctcctgtaacacatttaaacgttgggaaagtgtttccatcattgtctccttcatcctcgtcctgctgcaagtctaatctgcaccaagtcttttcaaaaaaacatttccagtttttatcattgattgtatacactgggttcctgttttggtcaaatggaaatgcattaggaaatttaaacacggttagtctactatgtaaatacggccacctattgtcttctacagggttagtattggatgttattagcattggtggacactttatttgtattaggtgtctgtgttttctatctaaacttattgggttaccatctaatgcatttctcatgtaattatcaaaatatgaccagcatgtacctgttgcgtcatctagcatggctatttttgcatctgcaagtggctctaaccaaaagtgacttgctgaatttacatatgaaattattgtgccttgtaaaaaatgtataaggctcatgcaaaaatatgacttgcctgtatttggcggcccatgtataactatacaatttcgttttggcgtgccttttaaaaaatcttttaatgcacataaaaatgttataaattccagtccttgatatcttaaaaattgtacaattgggcgccaatcaccgccttcgtcacatttactgcatctaaatttaatccattgtggcattgtcatttgtcgtttttgcgcccgtttgtaatgtctacacattgttgcacaatcttttacatattttgcttgacagttgctttttaaaaacgctgcagcattactattacaatctgctaacatagcatattgaaatgctatatcactgtcatctgttaactcattatcaaatgcccattgtaccatgtctgataaatcaaatacactatcatctattccatgttgtattatggttaatctttttatccattccggcgtgtcgccacacacctcactaatattagatattcctgttctataccaatataatgctgcaacagggctacgtaattttggtggctgcaaaagcatacagctgtctggaacatgcaacaatgtactcaatccttttcctactgttattctattttttccacatttgtatcttattagcattagtattaatattccagtttttgtatctaaacattgtatatgggtatacaatgcatattgtttaattagtgttttaaacccttccgcaatggttggatttactccaaatattgctgctacccagtctgtacatgtggttttatcacttttaaat

SEQ ID NO: 56 - DNA, 450 bp, Human papillomavirus type 68
gcaaataactgttccctacgtaaacaaaaaaacatactgtctccatacacatctgcagacatttgcaaatagtcaggatatttgcaaacagattgacatatatccaaaggtacctcgcttttcgtttcttgtaatgtaccaaagtccatagcaccatatcctgtatcaatcatatcgccatcctcaataggagtatttaccaattccaatgggggacagtccccttgttgtacattggtaggcttacaagatttacctttggcccagtgctcgccaatagcaggaacacagcctataatacacagctgtgtttgtttacagtccactgcaacattgtccctactgtctttaggatttttattagaggaaaacggggaattttcagtatcatccagcctattatatagtggatgcccactaaggccaacgcccaatggctgccccctacct

SEQ ID NO: 57 - DNA, 640 bp, Human papillomavirus type 73
atgttggctttggagccatggattttaaagctttacaagcaaataaaagtgatgtacctattgatatttctaacactacctgtaaatacccagattatttaggcatggctgctgatccctatggtgattccatgtggttttatcttcgtagggaacaaatgtttgttcgacacttatttaacagggctggtgataccggtgataaaatcccagatgacctaatgattaaaggcacaggcaatactgcaacaccatccagttgtgttttttatcctacacctagtggttccatggtttcttcagatgcacagttgtttaataaaccttattggttgcaaaaggcacagggacaaaataatggtatttgttggcataatcaattatttttaactgttgtagatactactagaagcactaatttttctgtatgtgtaggtacacaggctagtagctctactacaacgtatgccaactctaattttaaggaatatttaagacatgcagaagagtttgatttacagtttgtttttcagttatgtaaaattagtttaactactgaggtaatgacatatatacattctatgaattctactatattggaagagtggaattttggtcttaccccaccaccgtcaggtac

SEQ ID NO: 58 - DNA, 48 bp, Artificial Sequence
  Deletion Primer p26XF1 (Human papillomavirus type 26)
gtatttcaattgcctgccatgccgtgtaacactgtttacatgtgtgtc

SEQ ID NO: 59 - DNA, 41 bp, Artificial Sequence
  Deletion Primer p26R1 (Human papillomavirus type 26)
aggcatggcaggcaattgaaatacatatagcattgcagtcg

SEQ ID NO: 60 - DNA, 40 bp, Artificial Sequence
  Deletion Primer p26F3 (Human papillomavirus type 26)
gtttcggccgtgtaaccagtatggcttattaaatagttgt

SEQ ID NO: 61 - DNA, 39 bp, Artificial Sequence
  Deletion Primer p26XR3 (Human papillomavirus type 26)
cggccgaaacattccctgcaaaccacggatcaaaccggc

SEQ ID NO: 62 - DNA, 40 bp, Artificial Sequence
  Deletion Primer p33XR2 (Human papillomavirus type 33)
tttatctaatgtcttactaattccataaaacttattccat

SEQ ID NO: 63 - DNA, 40 bp, Artificial Sequence
  Deletion Primer (Human papillomavirus type 33)
ttagtaagacattaagtaaatcacagtatagtacaagcca

SEQ ID NO: 64 - DNA, 40 bp, Artificial Sequence
  Deletion Primer p52XF (Human papillomavirus type 52)
tgtgagtggttcatttatttaaaggaaggtatacacaaag

SEQ ID NO: 65 - DNA, 40 bp, Artificial Sequence
  Deletion Primer p52XR (Human papillomavirus type 52)
tttccttccatatgtgtttctggtatatttaacagctgtg

SEQ ID NO: 66 - DNA, 40 bp, Artificial Sequence
  Deletion Primer p58XF (Human papillomavirus type 58)
tagaccatttattgaacattggaaactaatacgcatggag

SEQ ID NO: 67 - DNA, 40 bp, Artificial Sequence
  Deletion Primer (Human papillomavirus type 58)
aatgttcaataaatggtctaactaattccataaaacttac

SEQ ID NO: 68 - DNA, 40 bp, Artificial Sequence
  Deletion Primer p39XF (Human papillomavirus type 39)
aatgctaataacttactaccgaattatcaaacaccaccgc

SEQ ID NO: 69 - DNA, 40 bp, Artificial Sequence
  Deletion Primer (Human papillomavirus type 39)
ggtagtaagttattagcattaaaattagtactccttgttt

SEQ ID NO: 70 - DNA, 40 bp, Artificial Sequence
  Deletion Primer p39XF1 (Human papillomavirus type 39)
gtcacccacctatcaatcatatcaccatcctcaatagggg

SEQ ID NO: 71 - DNA, 40 bp, Artificial Sequence
  Deletion Primer p39XR1 (Human papillomavirus type 39)
atgattgataggtgggtgacgccattcctgcccaattgta

SEQ ID NO: 72 - DNA, 39 bp, Artificial Sequence
  Deletion Primer pHPV56XF (Human papillomavirus type 56)
caatttacaaccgtgggcaaccaagacgccgcagtatcc

SEQ ID NO: 73 - DNA, 39 bp, Artificial Sequence
  Deletion Primer pHPV56XR (Human papillomavirus type 56)
tgcccacggttgtaaattgctacttttaaacaagtcctg

SEQ ID NO: 74 - DNA, 40 bp, Artificial Sequence
  Deletion Primer p56XF1 (Human papillomavirus type 56)
atgaattacaatataaattttgggatgttaacttacagga

SEQ ID NO: 75 - DNA, 40 bp, Artificial Sequence
  Deletion Primer p56XR1 (Human papillomavirus type 56)
aaatttatattgtaattcatattcctccacatgtctaagg

SEQ ID NO: 76 - DNA, 40 bp, Artificial Sequence
  Deletion Primer pHPV66XF1 (Human papillomavirus type 66)
aggaactattgaaggacaacatatagaagtgtggtttgat

SEQ ID NO: 77 - DNA, 40 bp, Artificial Sequence
  Deletion Primer pHPV66XR1 (Human papillomavirus type 66)
gttgtccttcaatagttcctgcaattggtgtgttggtgtt

SEQ ID NO: 78 - DNA, 40 bp, Artificial Sequence
  Deletion Primer pHPV66XF2 (Human papillomavirus type 66)
ctgaggtgccaggtatttgttactgttgtggatactacca

SEQ ID NO: 79 - DNA, 40 bp, Artificial Sequence
  Deletion Primer pHPV66XR1 (Human papillomavirus type 66)
acaaatacctggcacctcagcctttgattcctgtaattgc

SEQ ID NO: 80 - DNA, 40 bp, Artificial Sequence
  Deletion Primer pHPV68XF (Human papillomavirus type 68)
ctggtacgtacgacgtcgtctcggaagtatcccagacagt

SEQ ID NO: 81 - DNA, 40 bp, Artificial Sequence
  Deletion Primer (Human papillomavirus type 68)
gacgacgtcgtacgtaccaggtcattaaatgacaatccat

SEQ ID NO: 82 - DNA, 40 bp, Artificial Sequence
  Deletion Primer pHPV68XF1 (Human papillomavirus type 68)
aaaatgcctgatttcaacaccaacacaggcccataccatg

SEQ ID NO: 83 - DNA, 40 bp, Artificial Sequence
  Deletion Primer pHPV68XR (Human papillomavirus type 68)
gtgttgaaatcaggcatttttggaataggggaggcatggt

SEQ ID NO: 84 - DNA, 40 bp, Artificial Sequence
  Deletion Primer pHPV73XF (Human papillomavirus type 73)
attgctagcacagtagaggttagatatgactgtgaaaagg

SEQ ID NO: 85 - DNA, 40 bp, Artificial Sequence
  Deletion Primer pHPV73XR (Human papillomavirus type 73)
acctctactgtgctagcaatgctgcttttgcattattcct

SEQ ID NO: 86 - DNA, 40 bp, Artificial Sequence
  Deletion Primer pHPV73XF1 (Human papillomavirus type 73)
ttcctctaaactatcatatcaccatcctgtataggggtgt

SEQ ID NO: 87 - DNA, 40 bp, Artificial Sequence
  Deletion Primer pHPV73XR1 (Human papillomavirus type 73)
gatatgatagtttagaggaaacatatagatatgtaacatc

SEQ ID NO: 88 - DNA, 9347 bp, Artificial Sequence
  Human papillomavirus 33X truncated plasmid
ttccctattatcagcacccggttgtccaggatacttgttaccggtttcagtgtcatcaaatttgtttaataaaggatgaccacttatgccaacgcctaatggctgccctctacctatttcaaggcctacacatgcccatactaatcgttgtgtatcagggttataaaaggaggtgtcaggaaatccaaatttattaggatctggtaaacggaccctaaaaaccctatattgcaagcctgatactttgggtaccaataattttttagcgttagtaggatttttaatagaaaaatatggatggccaacagcaagaagtctggaactaccagcataataataaatgcttgtgcgagacacatattcatcagtgctgacaactttagatacaggtacaggaggcaggtacactgtggcctcactagaccgccacacggacatctcgagggggggcccggtacccagcttttgttccctttagtgagggttattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccggcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgacccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgtaaaaaaaatatggaaaacgtttacgcctgcgacgtaaaataaaataactaggatgtaaaacaaagtcagcaccgtctacaacaatggtgtcaaaaggaaaaaaaggcgaaataggaacaaatgggctagatgtgggaaataaaggggaaggtatatcagggccagacataacaggagtatcaaatcctgtatttaaaggtatagacacattgctggtacgtgttgttgcaaacgtactgtatgagtgttgcattggggtgtgtacattatccacatcgtcagcataaacatcatacaaaccatcattaatactataagacgatgtagaagtatcatgtaaaggctgtaattcatattgttcatttggcacggtgtggtctaaaggcacaataggacttaaatcctgataataatgtattctagctccaatttgtttaccactgcgagttttaagtgtggctttttgacctactctactaaaacgcacagtatgtctacgagatgtaatagcaggcctatgtaatgcaataatatctagaaagtcaggatcaggagcaggtgatatatcactatgttgaaattgtaatgtgtcttcagggtcaaagctttcaaatgcaggattatcatatgttataagtttatgaggcgatgttaaaaaagcagggtcaacaaccttaacctgttgggtattgcgactatataaaccaaggcgtgccacagggcgagaccctggaatgggcgtgcttgatgttacattactactgtctgtggaaacaacaaaggtatccattggtatgttttcataactttgtgtgctaacagtaggggaagaaaatataaaatgtccagaggcttctgcaggcgctggagggtgtagtacagatggttcagtaaatgtgggatttaaatgtgtagaaatagtttgaatagatgactccccaacagatgaaacattaataattgcaggtgtagtatctgcagatgtagtaacatcaaaacctgatggtgtaggaatagatggggctggtgcacctgcctctataaaacttgtttcttctattaatgacactatagacgagtctaaaggtccaacagtgtctacagtaaccggaggacgtataggctgcaaggggattgcagctgtaggtgggtcagtaccaataggtacatagccagtccttccacctgaaccagagcctgtgccaatacctaaaccaccaaaaaaaacccctaaactgccatatttaagaatttgatctgctatggtacttccttccactttaggaataacatcgggtgggcaggtgcctgtggccttgcatgtttggtatagttgtgttgcagatgcacgcttgcgccttgtagatcgtttgtgtctcataataatacactgctaaaatataaaggtatttattagtaatacaaaaaaaaaaaaactaaaataacaacaacaatgttaaaacaccaccatgtgcacatatatacaaacaatatatacatgtatatacattactcttgttgtgtcatatgctgtgcatgaaaattaatacacatcattggtaaatataaaaacaacaaatagcaaaaaaaaatttttaaaggagatcccacaaacacccaaagcagcaataccaacacctgcaaccaagcataggtagaaatggaaagtattaaaggacgtaataataaggataagcataaaaacaatataaaacataatacaaaaacaaatatcatggttatatacaattagcagcacatattggcttgtgatgtacacttataatgtcataaatccagtacttatttgcacagtaggtggtatttttacggtacctaaaaacatttgttgttgctgttcagttacaaatgttacagttacaattccatttttactatttttgttgtcactggtccaatgccaggtggatgacatagaactatacaactctttataaggttttaatctgtatcttaaacattttaaactatttgattcaccttttaaatgcactataggtgcaacgttaggactacacacagtccgctgcttgtttgtgcagttagttgcagtacgtgctgttctattgtccaaggcggggtctgcacagaacagctttgtaaggggctgggcggtgtctgtggtgtctgcaggtcgtcgtcgtttggccgctgcttgtggtggtcggttatcgttgtctgtctgtatgtcagcagtttcagtagtggatatttggttgctagatatagacgtaggacaaacaattacctgaccacccacatgtacttcccacatttgtgttttagaatactttgcagcatcctctttaaaatatttaaaatataccttttcacagttatgtatataatacatacctatataatctactttccctgtaaccatagtacatgtatcttcctctataatatatatttcaccccagtttgtataatccattgtattttttttgtcattgtcatattgcacagttactgtttctccttgttttttaaaacattttggtggttcacaaagccacacctctaagcttgtttgttgcaatgtccattggcttgtactatactgtgatttacttaatgtcttactaattccataaaacttattccataggcctctttaaatttatataatatatttgcttttgtattactactatgtagaacattactaatttcctgcaacgtaacattttcacagctatctacatttgtctcacagcttacttctgaatcatcccccaccccactagattctaagtcatttaagtttgtgtcgccattttgactttctacctgttgtaccatctgctgagtttccacttcagtattgccatatccgctgtcttctagctcatctatttttcgttttctgtatgtgcattctttatttttattaatagacgttctacacgggtttgcagcacgatcaacaacgtcctccgcagcactttgtgaacatgcggcaaactttcgttttagtgcacacacagcatttaaatcatcctccccttcctgtatattaaacaatgcccgggctgcctctgtgtctgcctgtatactattttccatagaatcatctataaactctagtaaatccgtgccactgtcatctgctgtttcatcctcatcttctgaaatattatctcctgttcttctctctatgactgcttctacctcaaaccaaccagtacaccccatcccagccccatttgtaccttcaggatcggccattgtagatgatgtttattgttgtgcacaggtagggcacacaatattcactgtgcccataagtagttgctgtatggttcgtaggtcacttgctgtactgttgacacataaacgaactgtggtgttacaagtgtgacaacaggttacaatgtagtaatcagctgtggctggttgtgcttgtccatctggccggtccaagccttcatcctcatctgagctgtcacttaattgctcatagcagtataggtcagttggttcaggatataaatctaaaacatattcctttaacgttggcttgtgtcctctcatggcgtttttacacgtcacagtgcagtttctctacgtcgggacctccaacacgccgcacagcgccctgcccaacgacccgaaatattatgaaatcgtttgtttaaatccacatgtcgttttttttcttgaggacacaaaggtctttgacatataatacacctaattaatatttcatttaaaggttttttaactgtttgttctaatgtatttccatatacagaataattataatgtctatattcactaattttagataagaaccgcaaacacagtttacatattccaaatggatttccctctctatatacaactgttaaatctgcaaatgcaaaatcatatacctcagatcgttgcaaaggttttttgcattccacgcactgtagttcaatgttgtgtatagttgtctccaatgcttggcacaaatcatgcaatgttcgtggtttttcctcagtgtcttgaaacatagtcgtgcagtaccttactgcaaaatggttgctttatatatgcaccgttttcggttgaaccgctttcggttacaccctacttttttaaaacttggcattatagtttactattatataaaagattataaatgaccaatatgacctaaaacggttagtccacacctggtaataaacaggtagtgactcacttttacaaggcatagtttggcatacaaagcaattgtgtaagccaaaactgcacttaaggtttgaaagtaaagtaaaaatatgtgcctaaaagcatgtgtaaactattagtacaattaagtattttgcaattgcactgcatgtatatatgagtcaatgcagcaagtacagacaaacacagtgcaggaaagaaaaggattaactgttctgccaatgtcatagggtatgtatgccaatgcagcaagtacagacaaacacagtgcaggaaagaaaaggattaactgttctgccaatgtcatagggtatgtatgccaagtaaccgaaaacggttaggcatacaaaatggaggaaattgtacaatatggacactagtatgtcaaaaggtaaagcaatactaaacatgtaggtactacaaatatagggaaataaaggtaggtacattgcaatgcagggtagggcaagcaatacaactccttactcatataggtacacccatatacataacatacatacaaatagtttaacaaatacacacaatgttttattaacatatacacaaacaggaaactgacaagtacatagaacatgcacacaaacaagtacacataaaacaaacacagtaacatacaacataacatacattgtaacacatacacaaaaaacaaacaacaacacaacacaacaacacaaagtacatagacagaacaaaacaacaacataacacaattacacaaagtgttattttttaacctttttgcgttttgcagacgatgtgcgggtggatgtgggggctgcacgtttaagtttaggttttgctttaagacctgcctgtaataaaaacttgcgtcccaaaggaaactgatctaaatctgctgaaaatttttcctttaaatccacttcccaaaatgtatatttacctaaggggtcttccttttcctttggaggtactgttttttgacacgtaatagcctgagaggtaacaaacctataggtatcctgtaaactagcagatggaggaggtgttaaaccaaattgccaatcttctaaaatatctggattcatagcatgaatatatgtcataacttctgcagttaaggtaactttgcatagttgaaaaacaaactgtagatcatattcttcaacatgtcttatatattctttaaaattttcatttttatatgtactgtcactagttacttgtgtgcataaagtcatattagtactgcgagtggtatctaccacagtaacaaatacctgattgccccaacaaataccattattatgaccttgtgcacgttgtagccaatatggcttattaaataactgagattcggaagtaaccattgatccactaggagtgggaaaaaaagcactgctttgaatagaggcagtagttcctgaacctttaatgtacaggtcatcgggaacagcctctcctaatgtaccagccctattaaaaaagtgtcttacaaacatttgttcacgtcgaagaaagaaaaataaactatcaccataaggctcactagtcatttttaaataatctggatatttgcatgtactgccacaaatatcaataggaacatcacttttattagcctgcgatgttttaaaatccatgcaaccaaatcctgtgtccaccatatcaccatcctcaataatagtatttataagttctaaaggtggacaatcattggcaggtgctgcattagtacaagcaacacctttaccccaatgttcccctgttggaggcttacatccaagtaaacataactgtgtttgtttataatccatggataaaca

SEQ ID NO: 89 - DNA, 8848 bp, Artificial Sequence
  Human papillomavirus type 39XX double truncated plasmid
catctcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagtcactggtaacaggattagcagagcgaggtatgtaggcggtgctacagagttcttgaagtggtggtctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattgtcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcatttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgaaaaaaaatagggaatacgtttccgtttttttaggaaaaaatacaataatggcaacaaataataattggaaccctgaatggttattgcatatgttgtgtctattggtccagaaggcaccaatggcaactgtggagtagtacttggtaaagcaatatcaggaccagtatttacaggcatattccatgaggtactaaaaggaatagttgtattggcatatttagtagatgctgaagaagccacagaaggtagtgagcctgtgttatatgtagtgcccgaatcccttgtattattaaatgcagtatctaaatatgtgttattgtccacatcagcatatatatcaaataatgcatctgaagcatcagagggctcagcgtgaactaggggctgtaattcaatgctttcagcaggagcaatactactaatgtcatggtaataatgtacttgcgctccaatttgtgtgccacgccgggtaaccatggtagcctttttgccaagcctactaaaccttactgttcctttacgcgaggttaaggcaggcctatgtaaacgaacaatgtccagaaaatccggatctggagctatgtcagcagcttcatatgttaatgtagtatcaacaggctcaaaagcaggattatcaaatgttacaaatgatgaagggtgagttacaaaatcaaaattactaacacgaacctgctgatgtgctctactatataaacgtggtcctgccacacgactgattccaggtgtaggtgtgctgctaataggttcggtacctgtgccatgtgtggcaaacacttccataggtatttcctcatagccatgtgtacctgatgtaggggtactgacaaatatattacccgaggtttcacctgtttggggaacctcaattaaggaaggatccgtaaaggcagggttagtataactagtagaggttatttgtacagacccagaggagggtgtaatattcaataccgcaggcgtagtagtagaagaagaagtaatttcaaatccagaggtgcctgtaaatgttggtactggtgttccagaggttataacacttgagtcctccaccaattgcacaatagatggctcagaaggaccaacaggttcaatagctacaggtggacgtgcaggagacacatctacaacagtattaggcctaccccccaggggtatatatcctgtgcgtcccccagtaccagtacctgtgcctatgcctaacccacccaaaaatatacctaaaccagtccactgtaaaattttgtcagcaagtgtagtaccctcaactttatcaacaacgtctggtggacaggtacccgattgtttacaggttctatataggtcagttgcagatgcacgcttacgcctggcagcacggtgggaaaccatgtttattagtaacaaaaaaaaatataaaaagctatgtacagtagttatgcacaatgcacatacatatacagtactatatcatatccattgccagtctatgcaacaaccacatgggcaatacaaaaaatagtaaatatacaaaaaacacctccaatggtgtggtacgtataagaataaacacaaacacaattatccacacatacgcacacacatgcacagacggcaaaagcgggacattgcaacatatatatatacacacaccaaaccacaccaaaaataccaataatatcatctatgtagtatgtatacaatatacatacacaatacccatagtatactttacaatgtcatgtaacccaatgaaacatgtacactagaaggtattttaacagtgtccagaaatttttggcgttgtgactctgtggcatatgtaacagttaatatgccagcgtttttggttcccttaccccgtatccaatgccaggtacatgaaatattttcaaacaatgtgtcatatttttgtagtctatatcttaaacattttaaaccatttttgtcaccttttaaatgtattataggcgtagtgttaccacaactgaggtaccgtcttgtgttgtggcctgtactgttactgtggagtgggttgttaagatggtccagggacactccgtcgggctcagtgggctctgtgactgcacactgtcgaggtcgctttcgagacggcggcgggattgttttttgggtgcatggggttgttgcggtggaatgggtcgcggtggtgtttgataattcggtagtaagttattagcattaaaattagtactccttgttttgtgtctaagctttgtatatgtgtatataaggcatatttgttgattaatgttttaaatccttctgcaatagttggatgtactccaaatatggctgccacccagtctgtacatgttgttttatcacttttaaacgtacgtaccaggtcagtaaaggatagtccatatgtttctttaaattgtgttagcattgcagcctttttgttattggattgtaacaataatttaatttgtgcagttggagatttgggatcctggttttcactatctatagcactatccacactactacactcctcccgtacactgccgccatgttccccttcagcatccccatttgtattagttgctacagttacctcctccacttcagctgtttccacttccatattgccatatccgctgtctggcacggaatacaccgtttgtgttgcctgcgtactgcttacatttaatgaaatttcctgtagtgttcccctggtattcctgcctactttttttccatacggtctagtgtcgccactgctgtctgtatactttcgttttaaggcacgcactgcttgtgcatccctttgggcctcttgcatatgtaaaagtacctgtgctgtctcacgctctgcctgtacacaaatatctgtggaatcatcaataaagtctgccaggtctgaacctgtatctgttgcattttcatcctcatcctccgacactgtgtcgcctgtttgtttatctactattgcctgtactagaaaccatccgttacatcccgacccatccccgtctgtaccttcacgattggccatagcaggttactggtttgcagttgcacaccatggacacacaaatcctagtgagtccataaacagctgctgtagttgtcgcagagtatcccgtgaggcttctactaccagctgcagtgtgttgttacacttacaacacgaacactgcattgtgtgacgctgtggttcatcccgtctggctagtagttgatgttggtgattaactgcatggtcgggttcatctatttcatcctctgactctcctaattgctcgtgacatacaaggtcaaccggctgtatttcattgtaaggacataaatctaatacaatttcctgcaaggtgggctttggtccacgcatatctgatgttatacttgggtttctcttcgtgttagtctgcggtcctcccgttttgtggtccagcaccgtcgacactgtcctgtatagcttcctgctattttatgaaatcttcgtttgctatttaggtgtcttaatttttctgctggacacagcggtttcagacaacacatgcaccttattaataaattatataactttgtattagttatattttctaatgtagttgcatacaccgagtccgagtaatatcgtagctcccgtattttagcataaaattttatacatgattggcatgcagctagtggttccccgtccctatatactacatataaatcactaaatgcaaattcatatacctcggtttgctgtagtggtcgtctgcaatagacacaggctattgtaatgtcctgcaaggtggtgtccagcgttgtgcacaggtctggcaatttgtatggccgttctgcaggattgtgaaatcgcgccatcggtatggacagaaactgtgactgcgttttatatccaccgatttcggtcctgaccgttttcggttactccctttttttaaacaagatacttataaaatgttataagtaaaagtataggtatgtatgcccaacctatttcggttgcataaactattgtgtgctacattagtcacttgtataacttatactgtaagacacattcctgaatcaaaaagtagttatacaggccaactatttaattaagcaagtaaaaacagctaaaatatatgcctaaaagcagttttattacatagggtggagatatggatgttgccaaagtattgttgcagtgcacctggacaggatgatgagtaataaggcgcgccagtaaaactgttaccagtgccaactatgcagggtgaacctaaggtaaagacatgtttttgctgagaaaggtggtttccactagtttaaaaaaaatgctcaacccacgaccgacttcggtcgccacaaaatggcgaagtataaaatgtagaaacgcgtacaacaatgtaaaaattacatattaggtagtaaacacaccttagggtagggcatatagattatgtatgaaatgttgcagacctattatatgtaaaacaaatacactgttagtcacagggtgtgcaatcacacatgaaactgtcatacatactttattaacaaaaacatatacacacatacctacaaacatacacatatacactcaacacataaggaaacaaacaacatacacacacataacaaggcatacacatgcattatttagacacacgtttacgtttgtgtttagtagctgaggacgaggaagtggatgcagcaggccgctttcggggacctatggtagggcgcctgcggaccctggcctgcaacaaaaatttacgtcccaaagggaattgatcaagttccaaactaaacttttcccttaagtcaacattccaaaactttagaccgtcatatggatctttcttttcaggtgctggagcatccttttgacatgtaatggctgcagactgtaggtatctgtaagtgtctaccaaactggcagatggtggaggagctacagcaaaattccaattgtccaatatagaggaattcatagtgtgaatataagacataacatcagttgttaatgtgacagtacacagttgaaatataaattgtaaatcatactcctccacgtgcctggtatattccttaaacttagaaggatcatatgtagaaggtatggaagactctatagaggtagataatgtaaagttggtactacgggtagtgtccacaacagtaagaaataattgattatgccaacatataccattgttgtggccctgggccttatgtagccaataaggcttattaaataactgggaatcagaggttaccatggaaccgctgggagaggggcagtatacagaactaccggggtttgcacgtatatctgtgcccttaatatacaattgggcaggaatggcgtcacccacctatcaatcatatcaccatcctcaataggggtgtttactagttccaaaggaggacagtcccccgtagatacattattgggcttgcatgcctttcccttaccccagtgctccccaatggcgggaacacagcctataatgcacaactgtgtctgtttataatccacagacacattatccctactgtccttattggtggttgatgaaaatggtgagttttcagtatcatcctgtctattatataatgggtgtccactaataccaacacccaatggctggcccctgcccacctccacccctacacaagcccatactaaacgttgtgtttctggattatataaggatgcatctggaatactgaatttattaggatcgggcaatgtcacgcgaaataccctatattgatatgcagacacctttggaatgtcctgcttgcgaccaccattcatacccactttaaaatatggatgtcctactgttaataatctagagctgccagcataataatatatgcctgtgcgtgtaacataatcatcagtattgacaaccttcgccacagaaggtggaggcaaatacaccatgctgtcactagaccgccacatagc

SEQ ID NO: 90 - DNA, 9459 bp, Artificial Sequence
  Human papilloma type 52X truncated plasmid
gcctgtaaaaaaatatggaaaacgtttacgcctgcgacgtagtaaaaaataactaggatgtaaaataaaatctgtaccatcaacaataatagatgtagatggagctgtaggggctataggaacaaaaggagtatgtgtgggtaacgaaggtaatggaatgtcaggacctgactcaatggacatagtgggttgatatacaaagtcaataccactattaataggtacagtgaaagtattattatgggtagaaagtgtggaaggtaagtgaaacgtgggttgctgcaaagaatctgcatacacatcatacaaaccatcattaatagtgtaaggggacacagactgtggtaataaaggttgcaattctatgtcttcctgaacttcagcaggctggataggactaatatcatgataataatgtacccgtgccccaatttgttttccactacgtgtacgtagggtggccttattaccaagcctgctaaacctaacagtacctcttcgagaggttaatgcaggcctatgcaaagctataatgtctaaaaaatcaggatccggtgcaggtaaaagttgtgaacgatcaaaaattatagtttcatctgtatcaacgccctcaaaaacaggattgttatatgttactaatttctgtggtgatgacataaaagcagggtcgactaccttaacctgttgtgtggcacggctatataaaccaaggcgtgtcgtagggcgagaccctggaataggtgtactacttgttacactgctgctgtcagtagaggtaacaaatgtatccatagggatttcttcataggtgtgtgtactaatagttggactagaaaacaatacatgaccagatgcttctgcaggtgccgggggctgtattatagatggttcagtgaatgtaggatttaaatgtgtagaaactgattgtacagatgattcacctatagatgttacattaattattgcaggagtattatttgcagatgttgtaacatcaaaccctgttgctgatggaatagatggagcaggtgcgccagactcaataaatgttgtttcttctatcatagaaactatagatggttctaagggaccaatgggttctacagttacagggggacgaatggtggacgtggtaatactactagtgggaggacgagtggacaatggcacatagcctgccctaccaccagagcctgcacctgtacctatacccaaacctccaaaaaacacccctaggctgccatattttaaaagttgatctgcaatagttgtgccttccactttaggaataacatcgggggggcaggtgccagaggctttgcatgtttgatatagctgtgttgcagaagcacgtttgtgccgtgtagaccgtctgtatctcattgcgacaagctattaaaaaatataaaagtatttattagacaaactacaaaagtgaaaaagtatattttgcatatatgcatgtagccaatctacatgtacagttattgcagttgtgccaaatactgtgcatgacagtgaatacaaaacattggaaaatataaaaacagtaggtacaaaaaaaacactttaaatggtgacccaatagatacccatagcaaaagcaccagcaccaacacctgcgcatacaccgatatagatagcaagagcggcctaagcactgcacaaaacaccataagcaaaataaaacaaaatacaaataatcctaacattgttatatatacacaatagcagcaatattggcttgtgttgggtgtttaccatacacatatacatatatacatatgtacaaatatcacaatgacatgacaccttgtataacttgcacagtatttggtattttaacagtttttaaaaattgttgacgttgtgtttcatcactgtacgttattgttacaatacctagtttattatttgtacattcattactggtccaatgccaggtagatgaaatttgaacatacaaacttttatgtgtttttaccctatatcttaaacattttaaactattaggatcaccttttaggtgtattataggtgcagtacaagttgtatgtgcaacccgtcctttgtttgtgcactcagttgcagtgacgagtccccgtgtagtactgtccacggattgttgtccccgcaaaaggttgttggggtacttggtgtttctggagtctgtgacgtctggtcgtcgtcgtttctgtggtggttgtaggtgtgtgtctttggcacccacggacactgcggaggtcttggaggtttcggtgcataggtggacagcagtttcagtagtggatacttcgttactagatacagatgcaggacaaacaattacctgaccacccacatgtacttcccatactcctgttacacaatattgctttgcatcgttactaaattttacaaaatatattttttctccatcacaccaataatataacccatagtaatctacttgtccttctacaattgtacattcacactcaccaagtaaataaatttccttccatatgtgtttctggtatatttaacagctgtgacattagtttggacactgttaatctgttttttccacatttaaacctaattagcagcagtataagcacgcctctgtcacatgttaaacattgcaaatgggcatatatgctatagggctgtattaatacttttaatccttctgcaactgatggtgttactcccattcctataatacaccaatctgtacaactacttctattacttttaaatggtcttactaattccataaagctaacaccatatgtttctttaaatttaaataatacagttgtttttatgctattttcgcacataatattttgtatgctttttagcgttctattactattttcctcattgtcctctatactagtacaacttacatctgaattactagcccccaccccacttgattgactactgttactttgccagtcgccattttgcccgtctacctggtctgccatctgctgcgcttccacttcactattgccatagccgctgtcttctacgtgacatggtttgcgttttggtaaaacacactctgtatttacacaaatgtgttttgcacgcggactaccatgtttttctacaccatcttgcccagcactttccggactgcttgtaaactttcgttttactgcagacacagcatgtaaatcatcctccccttcctgtgcattaaacaatgcccgggctgcctcatgttctgcctgttcattatttatatttgaatcatctataaaatctattagatctgttccactatcatatgcattttcatcctcgtcctctgaaatgttatctcctgtttgtttttctattattgcctctacttcaaaccagcctgtacatccctccctttcgccctctgtaccttcagggtcctccattgcagggttgtttatagccgtgcacagccggggcacacaacttgtaatgtgcccaacagcatttgctgtagagtacgaaggtccgtcgcagtgctatgaatgcatagccgtagtgtgctatcacaactgtgacaatatgtcacaatgtagtaattgcttgtggcttgttctgcttgtccatctggccggtccacaccatctgtatcctcctcatctgagctgtcacctaattgctcatagcagtgtaggtcagttgtttcaggttgcagatctaatatataatcttttatagttgctttgtctccacgcatgacgttacacttgggtcacaggtcggggtctccaacactctgaacagcgccctgtccaacgacccataatattatgaaatcgcttgtttgcattaacatgtctttctttttcttcaggacataatggcgtttgacaaattatacatctaatagttatttcacttaatggtttttttaccctctcttctaatgttttcccatacagtgaatattgataatgcctatattcacttatcttagataaaaagcgtaggcacataatacacacgccatatggattattgtctctatatactattcgtaaatctgtaaatagaaacttgtatacctctcttcgttgtagctcttttttgcactgcacacactgcagccttatttcatgcaccgattcttccagcacctcacacaattcgtgcagggtccggggtcgtgttgctggatcctcaaacatggccgtgcgttagctacactgtgttctatatatatacaccggtttcggtctgaccgttttcggttacaccctattttttactagtataagattataatttataattataaaaaaaagtggttgtgggtacggtaaccgtaaccggtcgtgtagtgcacacctggtgagtaacagtatttaatcatgttttacaagacatatttggcgtaggatgtacttgtgtaagccaacactgtaattagtgcattgaaagtttaaataaaatatgtgcctaaaagcagtttaaaacatgcaatgttaggcaatgtattgtttagctgcactgcaggacctgtgagtcagcaagaagtcagtttaggcgggacaacaagtgtagaccagtggactgcaggaaaccaaaggattaagcagtttgctgaaacttatataaaaatagttgttactgtgccaaggacaaccaaagttgtgccaagaccaaccgaattcggttaggatttaaaatggtggatagtacaaaatggtacaaaatggagagtataaggctaattagtagtgtaacaaagtaggacacagggtagggcaggggacacagggtagggcaggagatgcaatagattaggagcaactgtattgttactcatgtgggtgcaaccataacataagactactataaatagtttagtaaatacagtactttattaatacatacacaaaacatacatacaggaactgacaaatacaacaaacatgcacacacatacataacatgcaaacaacacagtacacacacaaaacaattacataacaaacaatggttaccttttaacctgtgtttgacatacacaacacatacatgacacagacaattacccaacagacaatggttaccttttaacctttttcttctttgtggaggtacgtggggccgatgatgcagggcgttttagtttgggcctagcctgtagccctgcctgtaacaaaaacttcctacctaaaggaaactgatctaaatctgcagaaaacttttcttttaaatccacctcccaaaacatatagtcctttaaaggatcttcctttcctttaggtggtgtgtttttttgacaagttatagcagtagaagtgacaaatctgtatgtgtcctccaaagatgcagacggtggtggggtaaggccaaattgccagtcctctaaaatagtggcatccatcttatgaatgtatgtcataacatcagctgttaatgtaattttgcacaattgaaaaataaattgtaaatcaaattcctcgccatgacgaaggtattccttaaaattttcatttttatatgtgctttcctttttaacctcagcacataaagtcatgttagtgctacgagtggtatccacaactgtgacaaacaactgattgccccaacatatgccattattgtggccctgcgcacgttgtaaccagtacggtttattaaataattgggattctgaggttaccatagaaccactaggagtaggaaaaaaagcactgctttgtacagtggcagtattgccagagttagacccttgtatatataaatcacctggcacagggtcacctaaggtaccggccctattaaaaaagtgtctaacaaacatttgctcacgtctaagaaaaaagaacaaactgtcaccatatggctcgctagccatttgcaaataatctggatacttacatacactgctacatatatcaatgggcacatcacttttactagcttgcaaggtattaaaatccatgcaaccaaatcctgtatctaccatgtccccatcctgtattacactgttaatgagctgtaggggaggacaatccccaggatttcctgaattattattacaaggggttcccttaccccaatgttcacctataggaggtttgcatcctaaaatgcataactgagtctgcttataatccatagataaacattccctattatctataccaggtttaccagcatatttgttactggtttcagtatcatcaaacttgtttaataaaggatgcccactaatacccacacctaaaggctgtcccctaccaatttccaagcctgtacaggcccacaccaacctttgggtttctgggttataaaaagatgtatctggaaaaccaaatttattagggtccggcaatttaattctaaataccctgtattgcaggccagacaccttgggaactaaaacttttttaccattaccactactggtgtttttaatagaaaaatagggatgtcctactgttagtaatcgagaactgcctgcataataatagatgcttgtgcgagacacatactcatcagtgcttacaaccttagagacaggtacaggaggcaggtacacagtggcctcactaggccgccacacggacatctcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtgggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggcc

SEQ ID NO: 91 - DNA, 8559 bp, Artificial Sequence
  Human papillomavirus 56XX double truncated plasmid
ggatccctgtatatatacatcatgggtaacatcataaggagactgaggaacaaagggccacgtactggggcctgtaggcaacactatgtcaggacctgaataaaatggtgtttcccacacattacctaaaggggcagttacattagtggtgttactagcaaaagacaatgtggaaggctttataggtaagtgtgcagaaggtgtagcaactgactggctagacaaaccaggtgcttcatcatctatatttgcataaatatcatataggccatcaaatgaattatttgcagacaataatggctgcatttcaatttcctcagcctgtgcaataggacttatatcataataataatgcacacgggcacctatttgtgtgcctctacgtgtttgtatagtagcctttctgccaagcctactaaaacgtacaccacccctacgtgtagtaaatgcaggcctatgtaatgctactatattcataaaatcagggtcaggagccacacccgacggagaaaaagctaaagatgtgtcagtaccttcaaaaagtggattatcagcagatactaatgttgcaggtctatcaagaaatgcagggtcagttaccttaacctgctgaaatgcttttctatataatctaggagctgcaatacgcctaaagcctggaataggagtactactaataggttctgtaccagaaccgtgaacagcaaatgtttgcataggtatttcttcatagctatgtataccagatgtgggtgtgctaattaaaatattgccagacacctcgcctgtttgtggggcctcaataacagggggatcaataaataacggattggttatatgggtactactgacatgtacagtactagaggttggtgtaatatccaacacggcaggtgtagttgttgatgaggatgtaatttcaaatcccccagacccagtaaaattaggaatccctgcaccagattctataacactggactcctcaactaatgtaacaatggaagggtctgtaggccctacggattccacaacaataggtggtcgcgccggagttacatcaactattgtggaaggcctagaccccaatggaacatagcctgcacgacccccagacccagttcctgtaccaatgccaaggcctccaaaatatgtaaataaacttccccattgcaatattttatcagcccatgttttttgctctattttattaacaacatcctctggacatgtaccagacaacttacatgttttatatagttgtgttgcagatgcgcgtttgcgtcgtgtggcacggtgggcaaccatagtagtaacagtactactacatttacatattatttattatccacaaagcatgtaaatatatacacagcacaggacagtaaaaaaatatcaaaaatattataaatgtattaaaaaaggatgtggctataacaaaccaaaacaatattattaataatatacaactggaaaacacagaggcagatagcaaaagcgggacaacatgacacacaagcaaacaaacacaaaagcaaagcgcaaacacaccaataacacaaaaatcaatggttgcaatatatatgcgtagcagcaatgtatggcaggtacacttcacgtatttgtgtgttacaataacacaaatgtatatacaatatatacagcactttatggaaaactcatttgtcccaaactaacctgtacactactgggaatttttacatgacttaaaaagctgtttcgttgtgtttcatccttatatataattgtaattatgctataatttttattgtctgtacttgtccaatgatatgttgatgttacatccacaaacaatgttttatatttttgaaatcgatatctacaacattttaatctgttaggttcaccttttaaatgtactacaggcgtagtcttatcaccagggtggttgttgttgttgatacttctacttctactgtcggtattgtctgtgtcgctgatgtgtgtgtgtgttgtgacacactttgcgtgggactctctggaggagtcaaattctgattcccgtagtctgggtcgttttcctggtctgtgggatactgcggcgtcttggttgcccacggttgtaaattgctacttttaaacaagtcctgcaattgttgtgttggcgtttcattgtttctatcaatatccatatgtattacagagtcctcactattgttactataggtactgttttgtgagcctccattttgtgtattcccgcacccacgtccctgtacctcttcatctacctgttctggtgtttccagagtttccaatgtattgccatacccgctgtcttgtaggtctgataaaataagcctccgttttactccttcccggcacacagtttgctgattactaatatcccttaatggactagctatatactttcgttttagtttttgcaacgtctgtttatctgcatgtgctgtttgtacttgcaacaattgttgactgtttctgcgtctgcctgtatattttgtatatatgaatcgtctataaatccatctaaatctgtatctatttcatcctcctcgtcactttcatcatctgatattttatctcctgtttttttttctacaattgcctctacttcaaaccatccacaacatcccttcccctccccatctgtaccttcaggtgacgccattgcagttagttacttgatgcgcagagtgggcacgttactgttaacgcacccataagcagctgttgtacaacacgcaggtcctctttggtactctgaatgtccaactgcaccacaaacttacactcacaacaaggtacgtgtattaggtaacacgtatgttgtttagcttgtctagcttgctgtggccgctcctgcaaatggtctacttcatcctcatcctcatcctctgagctgtccaattgctcattgcactgtaggtcaatttctgtttgaggtgttagttctaatacaacgtcttgcagcgttggtactttaccatgcatgattatactgtagattctctaggttctctagatgtttgtctccagcaccccaaacatgacccggtccaaccatgtgctattagatgaaatcgtctttttctgtcacaatgcaattgcttttcctccggagttaacggactttgacatctgtagcaccttattaataaatcacataactgttttttagttatactttctagtgtagctccatacactgaatagtcataatacctatattttctaactttactataaaacaataaacatactctgcacactgcataaggaaaatcatccctatacactaattttaattcagtgcatgcaaaattatatacctcagcacgtgttagttcttttttgcaatatacacatgataatctaagatcaattaaaggtatttctaatacctcactcaagtggtgcaggcttcgtggacgttcctgtggattgttgaattgtggctccatggatatgtccacacagaataagctgccttttatatgtaccgttttcggtcttaaacccttttcggtcactcccaatatataaaagtatgattgaaactttcaacaattaaaagaaacctgtttttgcacgaccgtaaacggttttaaaaaatgagtaattgtatgttacatgtttgcaaaacagatactgacagatacttggcctacatagtgtattctgcaagccaaaacaccaaagttgcagacacatgtataaaaatgtgtgcccaacagcactaaagtatgcagataaaagcatagttggcagtcatagtacctgtgagtaatacagggtgcggtactgtacataattcaagtataaaacacaggaaacggcaatatgccaaaggattaactgttctgctgaaaagggccttttggtttaaataatggcactaggccatgcaaccgaattccttttagtttaaataatggcactaggccatgcaaccgaattcggttgcatgtacaaaatggcggaaaaacaacaaaatggagtatgttatggtatatatatgtatgcacaatacacatagtacactgtacacaataacttacaaaacaaaagccacaataatgacacaccttagtttatgcaaccacgcgtaaaagcactcattcatgtttattacagacacacaaacattacacatatatacagtcatacatacaatgaatacacacacaaacatttcacacaaacacaacatacacatacaaagtataaaataaagcacatacacaaacataccatatatacaacacacaaacacagttacacaaacacacaacaacacactaccgccttttacgttttgctggtgtagaggtggaggtaggagcagatcgctttttagaggtagctacagcaggctttgacctagtgcccagttgcattaaaaattttctacccagtggaaattgatccaggtctgtagaaaaactgtcctgtaagttaacatcccaaaatttatattgtaattcatattcctccacatgtctaaggtactgattaatttttcgtgcatcatatttacttaactgttctgtagcagtactaatagtcatgttagtacttctagtagtatctactacagtaacaaataattgattaccccagcaaatgccattattatggccttgggcacgttgcaaccaataaggtttattaaataactgtgcctcagacgtaatcatagacccactaggcgtagcaacatatacagaactcggagggggttctctaccattgctaccctttaaatataactctgcaggtattgtttccccaactttaccagccctattaaaataatgtctggcaaataattgttccctgcgtaagtaaaaccacatagaatcaccataggcatctgcagacatttttaaatagtcaggatatttacaggtggattgtacaatgtctaaaggtacctcagccttagattcctgcaacaccttaaagtccatagcgccaaatcctgtgtctatcatgtccccatcctctataggtgtattaattaatgcaagaggcgggcagtcccctgtggtaacttgtgtggacttacacacagcacctttagtccaatgttcacccatagcgggagtacatccaacaatacacaactgtgtttgcttgccatcaactgatatattgtccctactatcttctataacattattatttgctaaattggaactttcagtatcatccagcctattaaacaatggatggccacttagcccagcacctaaaggctgtccgcggcctacctccaaacctacacatgcccacactaaccgttcctggtccggattataaatattagtatctggaagcccaaacttattagggtcgggcaaccgtaccctaaataccctatattgatatgcactaactttgggaatgtttgttttggtattgtccttagtcacagagtaatagggatgtcctacggcaagcaatcgtgaactgcctgcatgataaaatatactagtgcgttttacataggaatccgttgccacaacctttgaaacaggtgttggaggtagatacaccttattttcactaggccgccacgtcgccatctcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgcaaaaaaatagggaatacgtttacggcgcctacgtctaaaaaaatacacaggccataatgcaaagga

SEQ ID NO: 92 - DNA, 9442 bp, Artificial Sequence
  Probe
tgttacaggcaacacctttaccccaatgctcaccagtgggaggtttacagccaattaaacataattgtgtttgtttataatccatagataagcattccctgttatcagaccctggctgtgcgggatatctgttactggtttcagtgtcatcaaatttatttaaataaggatgaccacttacgccaacacccaatggctgtcccctacctatttcaaggcctacacatgcccagaccaaacgttgtgtatcagggttataaaaagatgtatcaggaaaaccaaatttattgggatcaggtaaacgcaccctaaagaccctatactgtaagcctgataccttgggaactaatacttttttattgttattgggacttttgatggaaaaatatggattgccaacagccaaaagtctggaactgccagcataataataaatgcttgtgcgtgacacatattcatcagtgcttacaaccttagacacaggcacaggaggcaggtacacagtggcctcactaggccgccacacggacatctcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccagrcgtttmcccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgcaaaaaaatatggaaaacgtttacgtctgcgacgcaaaataaaatagctagggtgcaacataaaatcagcaccatccacaattatggtattaaaaggagttagtggagatataggaataaatggactagacatagatgttacagaagatgcaatgtctggaccaggttccaatgacacaagaggagtgtcaaatccagtatttaatggtatggacacattactggtacgtgtggtggcaaaggacgtatgtgagtgcagaggactctgaaaatcatgtatagtatcagcatcgtcagcataaatatcataaagtccatcattaatactatagggagaaacagaagtatttaaagattgtaattcaaattgttgctgctgttgtacctgttcctggacaggctgtatgggacttaagtcttggtagtaatgtactttagcccctatttgctttccactgcgagtacgaagtgtagccttttgcccaaccctactataacgtacagtacccctgcgagaggttaatgcaggtctgtgtaatgcaacaatatctagaaaatcaggatcaggagcaggcgatatgtcactatgttgaaactgcaatgtgtcctcagggttaaagccttcaaatgctggattatcatatgttacaagtctatgaggagatgttaaaaaagcagggtcaacaaccttaacttgttgggtgttgcgactgtataaaccaaggcgtgccacagggcgagaccctggaatgggtgtgctagacgtgacattgccactgtcagtagaaataacaaaggtatccattggtatgttttcataactatgtgtgctaacagtaggagaggaaaatattaaatgtccagaggcctctgcaggtgcaggagggcggagtacggatggctcagtaaaggagggatttaaatgtgtagaaacagtttgtatagatgattctccaatagaggaaacattaagtattgcaggtgtagtatctgcagaggtggtaatatcaaaaccagatggagtgggaattgatggggctggtgcaccggcgtctataaaactagattcctctattaaagatacaatagaagaatccaaaggccccacagtatcaacggtaactgggggacgtatgggctgtaaaggtatagcctcagacggtggggtactaccaaggggcacatatccagtcctgccacctgtacccgaccctgtaccaatgcctaaacctccaaaaaacacccctaagctaccatatcgtaatatttgatctgctatagtagtgccttcaactttgggtataacatcaggtgggcaggtgcctgaggccttgcatgtttggtaaagttgtgtagcagatgcacgcttgcgccttgtagaccgtttgtgtctcataataagacagtgctaaaaatataaaagtatttattagtaaatgtataaaaataataaaaacaacacacacaacagtaaatatttacaataccataccaccatgtgcagaaccagtatacagttagtcttgttgggttaagtattgtgcatgaaaattaatacacatcattggtatatataaaaatattaagtaacagaaaaaaattcgtagagccgaccccacagacacccaaagcagcaacaccaacaccagcaaccaagcatatatagaaatagatagcaccaatggccgcaaaaaaatgcacaagcataaaaacagtataaaacaaacaacaaaaataggtaatatcattgtatatacacttagcagcacatattggcttgtggtttacatacagtaattgtacaatacaattacaatgacataacaccagtacttatttgcacagtgggtggtattttaacagtgtttaaaaacagttgtcgttgtgtttccgttgtgtatgttacagtaacaattcctactttgtcacctttgtcatcactggtccaatgccatgtggatgacatattacagtataagtctttaaatggttttaatctatatcttaaacattttaaactatttgggtcaccttttaaatgcacgataggtgaaactttagaactacacacgttccgccctttgtatgtacagttagttgtactgtgtagtcctcctcctcgtggtctactgtccacggcgcagtctgtatactttgtggagtactgggtgttgtctctggagtctggtaaatcgagtcgtcgtcgctttgtcccctgtgtactttcgttgttggtggcctcggtggtctttgggtcagcagtttcagtagtggatatttgatcactaggtatagatgtaggacatacaattacccgactacccacatgtacctcccataattgtgttttagagtacttttttgcatcctctttaaaatatttaaaatacgtcttttcattgccatgtatataatacaaccccacatagtcaacttctcctgctaccaaagtacatgttgtttcctcaataatatatatttcactccaatttgtataatccattgtgtttgctttatcattgtcatattgtacagttactgttatgcctttttttttaaagcatttttgtggctctgataaccacacttctaagcttgtttgttgcaatgtccattcatctgttttatatggtgatgcatttaatgtctctaatgccatttgcagttcaattacttgaaacgctttagtctttgatgctaccaatgacggcaccacctggtggcacaaatgtgatattcccatttgtctggctgtatacattatagcacactccatgcgtattagtttccaatgttcaataaatggtctaactaattccataaaacttactccataagcttctttgaatttatataatagcgttgctttagtattactgttatgtagaatattactaatattttgtaatggaacagtattacaactgtctacatccgtttcactgcttacatctgaactagcccccaccccactagactccgagtcatttaagtctgcgtcgccattttggctttctacctggtgtgccatctgctcagtttccacttcagtattgccatatccgctgtcttctagctcaataatttttcgttttctgtgtgtgcattctttatttttatatttccacgatacacacacatttgcagcccggtccacacagtcctctacagcactttctgagcatgctgcaaactttcgttttagtgcacacacagcatttatatcgtccaccccttcctgtacattaaacaacgctcgggctgcctctgcttctgcctgtgtagtactttgtactgaatcatctataaactctattaaatctgtaccactatcgtctgctgtttcgtcctcatcatctgaaatattatctcctgttcttcgttctattaccgcttctacctcaaaccagccagtacagcccgcccctaccccgtttgtaccttcagggtcatccattgcagatggtgtttattgctgtgcacagctagggcacacaatggtacatgtgcccataagcagctgctgtagggttcgtacgtcggttgttgtactgttgatacacaaacgaaccgtggtgccacaagtgtaacaacaagttacaatgtagtaattagctgtggccggttgtgcttgtccatctggcccgtccaagcctatttcatcctcgtctgagctgtcacataattgctcatagcagaataggtcagttggttcaggatgtaaatctaaaatatattctcttagcgttgggttgtttcctctcatggcgttgttacaggttacacttgtgtttgtctacgtcggggtctccaacacactgcacagcgccctgtccaacgacccgaaatattatgaaaccttttgtttaaatccacatgcctttttttttcttgtggacacaatggtctttgacaaataatacatctaattaatatttcatttaaacacttttttagtgtttgttctaatgtgtctccatatagcgaataattataatgtctatactcacttattttagatagcaatcgtaagcacactttacatactgcaaatggatttccatctctatacactattcttaaatctgcaaatacaaagtcatatacctcagatcgctgcaaagtctttttgcattcaacgcatttcaattcgatttcatgcacagatgtctccaacgcctgacacaaatcatgcaatgtccgtggtttctcctctgcgtcctggaacatagtcctgcagtagcctaccaaaaaatgtctgctttatatatgcaccggtttcggtcagaccgttttcggttacaccctagtttttacaagatttggcattatagtttagtattatataaaatgttgaaacatgaacaatgtgacccaaaacggttagtccacacctggcaataaatgttagtgagtcacttttacaagacatagtttggcataacaaactattgtgcaagccaaaactgcacttaagcattgaaagtaagttaaaatatgtgcctataagcatgtttaaactatgagtataattaaacattttgcaactgcactgcatgtatatatgagtcacatatgcaagtataggcaaaagcagtgcaggaagggaaaggattaactgtattgtttaaattgtagtttaaaaaaaacacgtttgtgccagcaaccgaaatcggttacatgcacaaaatggaggtaaagtaaaatggaggcagtactgttaaaaactataaaatacatatcatacaaatactattacataggtatgcataataggcagggcagggtagggcaatttagggacagcaccttactcatagatacacccaaacaatacaaatagtttacaatacacacaatagtttattacatatatacagaaacaggaaactgacaaggacatagaacatgtacacaaacatgacacataacacatacaacatatacacaaacataaacaaacagacaacacatacataaaacaaacaaacatgtataataaaatagtgtaagtaccacaacaattattttttaacctttttgcgtttggtggatggtgcacgggtagtaggggccgaacgttttagtctgggctttgctttaaggcctgattgtaataaaaactttcgtcccaaaggaaactgatctagatccccctcgactctagaggatctgcagaaaacttttcctttaagttaacctcccaaaaagtatatttatttaatggatcttccttttctttagggggtgctgttttttggcaagtaatagcctgggaggtaacaaatctatatgtgtcctgtaaactggcagacggaggaggtgttaaaccaaattgccagtcctccaaaatattggaatccatagtatgtatatatgtcattatctctgcagttagtgtaattttgcaaagctgaaaaacaaactgtaagtcatattcttcaacatgacgtacatattccttaaaattatcatttttatatgtaccttccttagttacttcagtgcataatgtcatattagtgctacgagtggtatcaaccacggtaacaaataactgattgccccagcaaatgccattgttatgaccttgtgcacgctgtagccaataaggcttattaaataattgtgattctgaggtaactatagagccactaggagttggaaaaaatgcactactttggataactgcagtattaccggaccctttaatataaaggtcatccgggacagcctcgccaagttttccagccctattaaaaaagtgtctaacaaacatctgctcacgtctaagaaaaaagaacaaactatccccataaggttcactggccatttttaaataatctggatatttgcatgtactgttacaaatatcaataggcacatcacttttattagcctgcaatgtaccaaagtccatgcatccaaaccctgtatctaccatgtcaccatcctcaataatagaattaaaaagttccaatggaggacaatcagtagcagctgcattat

SEQ ID NO: 93 - DNA, 8699 bp, Artificial Sequence
  Human papillomavirus 66XX double truncated plasmid
tcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtgaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaggacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgccagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgtaaaaaaatagggaacacgtttacggcgcctacgtttaaaaaaatatacaggccatagtgcaaatgtacctccctgtatatatacatcatgtgtaacatcataaggagactgaggtacaaagggccaagtgctggggcctgtaggtaaaactatatcaggaccagaataaaatggtgtttcccaaacatttcccaaaggggcagtaacattagttgtgttactagcaaaggataatgtagaaggtttaataggtaattgtgcagaaggtgtagcaccagactgacgaaatgaaatgggtgcctcatcatcaatatttgcataaatatcatataggccatcaaatggattgtctgtagacaataatggctgcatttcaatttcatcagcctgtgcaataggacttatatcataataataatgcacacgagcacctatttgtgtacccctacgtgtttgcatggtagcctttttgcctagcctactaaaacgcacacctgttctacgtgtagtaaatgcaggcctatgcaatgcaactatatccataaaatcaggatcaggagccacacccgagggagaaaaggtcaacgttgtgtcagcaccttcaaaaacaggattatcagcagttattaatgttgtggggttgtccaaaaatgctgggtcagtgaccctaacctgctgaaaagccctactatacaatctgggagcagcaaggcgtctaaaacctggaataggggtactactaataggttcgttgccagtaccgtgtatagcaaatgtttgcataggtatttcctcatagctacgtattccagatgtaggagtgctaatcaaaatattaccagatacctctccagtttgtggagcctcaattactggaggatcaatatatagtgggtttgttatagtagtactacttacatgtacagtactagatgtgggtgtaatatccaacacagcaggtgtggttgtagaagaggatgtgacctcaaagccccctgacccagtaaaattgggaacaccagcccctgagttaataacactagattcttctaccagtgtaacaatagaaggatccgtaggcccaactgactccaccacaataggtggtcgtgcaggagtgacatcaactatagtagaaggcctagagcctaagggaacatagcccgcccgaccacccgacccagacccagtaccaatgccaagtcccccaaaatatgtaaataaacttccccattgtaaaattctatcagcccatgttttttgctctaccttattaataacatcctcaggacatgtaccaggtaatttgcatgttttatataattgtgtggcagatgcgcgtttgcgtcgtgtggcacggtgggcaaccatagtagcaaaaacgtaatactgttacaaatggtttattaaccacaaagcatgaaaatatatacacagtgtaggtatataaaaaaatagtaaaaacagtataaatgtatcaaaaaatgatgtagccacaacaaaccaaaataaagtaattagtataagacaattggtaaacaaagatgcagatagcaaaagcgggacaaaatggcacacacacagacaaacacaaaagcaaagcgcaaacacacaaattacacaaatatcaatggttgcaatatatagcgattacacgttaccgtttccagtgttacaataacacatactataccaaatacaattaatgggtgcaatatatatgcgtagcagcaatgtatggcaattacacttcatatgtatccgtgttacaataacacatatgtatatacaatatatacaacactttatggacaactcatttgtcccaaaataacctgtacactaggtggtatttttacaacatttaaaaaggtgtcccgttgcgtttcatctttatataatattgtaataatactactgtctttattatctgtacttgtccaatgatatgttgttgttacatctgtaaataatgttttatatttttgaaatctgtatctacaacactttaatctattggcttcaccttttaaatgaattgcaggtgtagtcttatcaccacagtggttgtgtgtgttgatacgtgcacttctactgttggcgttgttactgatgtctgtgtctgttgtgacacggtgtgcgtaggactctctggaggagtcaggttctgattcacttgctctgggtcgttttcctggtctgtgggataccgcggcgtcttgggcgcccacagaggtggaggcggtggtggtggtcctgtggttgttgtattcgttaacagtctcaacagggggtacgttgtatctacaggtactagacacagggtcaggacaataaatactctcggtttccatatgtacttcccatatgtttgtacacccatattttttggcctcctgttcaaagtctgtgtaatatgttttgtggccatcatgcatataatatatgcctctgtaatccacccctgatgacactttacaccacccacactctccattataatatataaatttccacaccacatattccatacaattatttttgttacctccatatttgtatctatatccatatttaccaccgagtgctcactacagttactgttttgcgagcctccattttgtgagctcccgcacccatttcccttttcgtattctacctgttgtgatgtttccaatgtttccaatgtattgccgtacccgctgtcttctgataatattagccttcgttttacttcctcccggtacacagtttgctgattactaatatcacttaagggactacctatatactttcgttttagtttttgcaacgtctgtgcatctgcatgtgctgtttgtacttgcaataattgttgagctgtctccctgtcttcctgtgtattgtttataagtgtattgtctataaatccatctaaatctgtatctgtttcattctcctcctcgctttcatcatctgatattgtatcccccgtttttctttctacaattgcttctacctgaaaccatccacaacatcccgtcccctccccatttgtaccttcaggtgatgccattgcagttatttagttgacgcgcagagtgggcacgttactgttaacgcacccataagcagctgttgtaccacacgtagctcctctttggtactctgaatgtccaactgcaccacaagctcacacttacaacaaggtacgtgaattaggtaacacttatgttgttcagcttgtctagcttgctgtggccgctccagcaaatggtctatttcatcctcatcctcatcctctgagctgtccaattgctcattgcattgtaggtcaatttcagtttgcggtgcaagttctaatataatctcttgcaacgttggtgctttaccatgcatggttatactgtagattctgtggcttgtctactcgtatgtctccaacactgcaaacatgacccggtccatgcatatgctatataatgaaatcgtcttttatgttcacagtgcaattgtttttcctccggtgttaacggacattgacatcggtagcaccttattgataaatcagataactgtttttagttataccttctaatgttgccccatacactgaatatttatagtacctatattttctaaccttactataaaacaataaacataccctacatactgcatatggccaattgtttctatatactaattttaactcaatacatgcaaacctatataactctaaacttgtaagttcctttttgcagtatacacatgataatctaagatcaagtaaaggtatttgtaatacctcgctcagatggtgcaggcttcgtggacgttcctgtgtattgctgaatatggaatccatggatatctacaggcacaacaggctgccttttatatgtaccgttttcggtcctaaacccatttcggttactcccaatataataaagtatgattgaaactttcaacaattaaaagaaacctgtcttagcacgaccgtaaacggttttgaaaaatgagtaagtatatggttacatatttgcaagacagatacttggcttatacaataagggctacacgccaacaaaatatattgcaaacacctgcataaaaacatatgcccaacagcgccaaagtatgcagataaaagcatagttggcacagaaatactggtgagtaatacagggtaaggcagtgtacatacctgaatcatacaacaggaaacggcaatatgccaaaggattaactgttttgctgaaaagtcgttttgggtttaaataaggacaaaaggctaggcaaccgaattcggttgcatgcataaaatggcgtacagcactaaaatggagtttggtatgttactatagtgcatacaaacaacctatttaatataacagtaaacagtaaggaacaccacctaacctgacacacactgcccaaggatactaccgcaccttagtttatgcaaccacgcgtaaaagtaaccatgcatgtttattacatacacacaaaacattacacatacatacagtcatacatacacatagcacatacacaattataaaatacataaacatacacaaaaacatacagtacaagcacaaccatacaatacatacaacagacaacacacaactatcgtcttttacgtttagctggtaaagaagaggaagaggtaggagccgcccgctttttagaggcagatgcactagccttgggtctagggcctagttgcattaaaaattttctacccaaaggaaactgatctaggtctgcagaaaagctgtcctgtaaattaacctcccaaaacttatatttagccaggggatcctgcttttctgcagggggctgttccctttgacatgtaatagctgtgcttttaatatgcctatatttatcctctaagctagttgcaactggtggggacaatccaatgttccaatcgtctaataaagtattattcatattatgcaaatatgccataacttctgcagttaaggttattttacaaagttgaaacacaaactgtagttcatattcctccacatggcgaaggtattgattgatttcacgtgcatcatatttagttaatgtgcttttagctgcattaatagtcatgttggtacttctggtagtatccacaacagtaacaaatacctggcacctcagcctttgattcctgtaattgcttaaagtccattgcaccaaacccggtgtccaccatgtcaccgtcctctattggggtattaactaatgccaaaggtggacaatcccctgtattgactggtgtagacttacacaccgcgcccttagtccaatgttcacctaatgctggcgcacatcccacaatacataactgggtttgtttacaatcaacagatatattgtcccggttatcttctgcaacattattacttgctaaattagagacttcagtgtcatccagcctattaaataatggatgaccacttaacccagcacctaaaggttgacctcggcctacctccaaacctacacaggcccataccaaacgttcctggtcaggattatagaaagatggatcaggaaggccaaacttattaggatcaggcaaccgtaccctaaacactctatactgatatgcactaactttagggatgtttgttttggtaccagatttagaaacagagtaataaggatggccaacagcaagcaacctagagctacctgcatgataaaatatactggtacgttttacatatgtatccgttgccacaacctttgaaacaggtgttggaggtaggtacaccttattgtcactagaacgccatagagccatc

SEQ ID NO: 94 - DNA, 8331 bp, Artificial Sequence
  Human papillomavirus 68XX double truncated plasmid
taattgctgctgattgtaggtagcggtatgtatctacaagactagcagatggtggaggggcaacaccaaaattccaatcatccaaaatagcaggattcatagtatgtatatatgacattacatcagtggataatgttatagtacacaactgaaatataaactgcaaatcatattcctcaacatgcctaacatattccttaaatttattagaatcatacacagctggtacagtagagtctgtagtagtggacaatgtaaaattagtactgcgcgttgtatccacaacggtaagaaataattgattatgccaacaaataccattgttgtgtccctgtgccttgtgcagccaatagggcttgttaaataactgggagtcagaggacaccatagacccgctaggcgagggggcatacacataactactaggagtttcacgaatgtcagtgcccttaatatacatgtcagtgggaatagtgtcccctaccatgcctccccattccaaaatgcctgatttcaacaccaacacaggcccataccatgcgctgtgtatctggattatataatgtagactcaggaacactaaatttattaggatcaggtaaggtaaccctaaacactctgtattgatatgcagacaccttaggaatgccctgcttgcggcccccagacataggaaccttaaaatatggatggcctacagttaataacctagatgtaccagcatagtaatacatgccagtgcgtgtcacataatcatctgtattgacaaccttcgccactgaggggggaggcaaatacaccatgttgtcgctagctcgccacaatgccatctcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgctgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgtaaaaaaataaggaaggtgtttacgtttttttaataaaaagaataacaatggtaataaataataattggaaccatatatagttatggcaaaggttgtatcaattggagtagagggtgttaaaggcaactgtggggttgtagatggtaatacaacatcaggaccagtatttacaggcgtgttccaagcagtaccaagaggaatggtagtattagtatatgtagtggatgcagcagaagccaatgaaggaactgatatgtgggaacgagtagtaaatgtagcattatgaaatgcagtatctaatactgtagtattgtcagtatcaggtgcatatatatcatataagttatccatagggtccgcctgctcaggggcaaccaatggttgtagttcaatgctgtcagcaggggtaatgttactaatatcatgataatagtgcacctgtgccccaatttgtgtacctcggcgtgtaaacatggtcgcctttttgcctactctgctaaaacgtactgttcctcttcgggatgttaaggcaggcctatgtaaacgaacaatgtccagaaaatccggatcaggagctatgtcagcaggttcatatgtaagagtagtatcaacaggctcaaaagcaggattatcaaatgttacaaatgatgaagggtgcgttacaaaatcaaaattactaacacgaacctgttgatgtgccctactatataaacgtggccctgccacacgactaaccccaggtataggagtactactaataggttctgtaccagtgccatgtgttgcaaatacctgcataggtatttcctcatatccatgtgttcctgatgtaggggtacttacaaacacattaccagacacctcacctgtttgtggcacttctattatagtcgggtctgtaaatgcagggttagtaaaactagtactgcttacctgcacagacccggacgaaggggtaatgtctaaaactgccggtgtagtggtagacgaagatgtaatttcaaacccagaggtgcctgtaaatgttggtactggtgtcccagatgtaataacactggaatcctccaccaattgcacaatggagggttccgtaggacccacaggttcaataaccacaggtggacgtgcaggcgacacatccacaacagtattaggttttccacctaaaggaatgtacccagcacgacctccggtgccagagccagtacctatacccaggccacccaaaaatatacctaaacttgtccattgtaatattttgtctgcaagtgtagtaccttcaaccttatttataacatcagaaggacatgtccctgattgtttacatgttttatataagtcagttgcagatgcacgcttgcgcctggcagcacggtgtgaaaccatatttatttatacaaataaacaacaatacaaatgcacactataacagttactgtatagtattaagagtaagactgtgtaataaccacataggcagtataaaaaaaagtaggtatacagcaaacacctcaaatggtgtagttctaactaatataaacacaaacacaaatatccacacatacacacacacatgcacagactgcaaaagcgggacagtgcaacatatatacatgcatacacaaaaccacaccaaaaataccaatacaagcatatgtatacaatatacatatagtgtacagtgtgggtcaatacacacttataatgtcatataccccaatgacacagttacactagatggtagtttaacagtttccaaaaacttgtcacgttgtgcttctgaaacatatgttacagtcaatatacctgtattggttgatcccctaccccttatccaatgccatgtacatgatatattgtcatacaaagcgttatgtttttgcaacctatacctaagacattttaatccatttttgtcaccttttaaatgcactataggtgtagtgtcaccacaacaaaggctccgtcttttgttttggcctgcacttctactgaggagtgggaggtcgacaccgtccacggacacgttgtcgggctcagagggctcagtgattccgcactgtctgggatactccgagacgacgtcgtacgtaccaggtcattaaatgacaatccatatacttttttaaattctgttaacattgcagcctttttattgttacattgtaataatactttaagttgggtagtaggtgatttaggatcctggttttcactatctatagcactgtccacactactacagtcctcccgtatactgtcgccattttccccttcattttccccatcctccccatttatattaggtgctacagttacctccgagttagtttccacttccatattgccatagccgctgtccggcactgtatacgccggttgtcttgcctgtgtactgcttacatttagtgataattcctgtaatggcgactttgctaaaggactgctttctatactgtctgtatactttcgttttagggcacgcaccctttgtgcatccctttgggcctcttgcatattcaaaagtacctgtgctgtctcacgctctgcctgtatacaaatatgtgtagaatcatcaataaaatctaccatgtctgaacctgtatctgttgcgttttcgtcctcatcctctgagactgtgtcacctgtttgtttatctactattgcttctacaaaaaaccatccgttacaccccgtcccgtccccatcggtaccttcacaattggccattgcagattactgggtttcagttgcacaccacggacacacaaaatttagtgagtccataaacagctgttgtagtgtccgcaggttgtcccgcgacgcttctactactagttgcagtgccttgttacacttacaacacagacacgcgtgacgctgttgttcgtcccgtctggctagtagtagatgttggtggtgattaactgcatggtcgggttcatctatttcatcgtctgaatctcctaattgctcgtgacatacaaggtcaaccggctgtatttcattgtatggacatagctctaacacaatttcctgcacggtgggctttggtccatgcatagttacttaaacttgtgtttcttgacgtatgcgtctgcggtcctctcgcttactggtccagcagtgccgacactgtcctgtaaagtttcctgctattttatgtaatcttcgttttgttgttaggtgccttagtttttctgctggacacaatggtttcaggcaactcatgcaccttatcaataaattatataactttgtattagttatggtttctaatgtagttgcatacaccgattccgagtaatatcgtagttcccgtattttagcataaaatttaatacatgattggcatgcagcaaatggtaccccgtctctatacactacacataggtcactaaaggcaaattcatatacctctgtccgttgtagttgccttctgcaatagacacagtctattgtaacgtcatgcaatgtagtgtccaatgtcctgcacaggtctggcaatttgtatggccgttcctcagggttgtgaaatagcgccattagtatagagaactgctgtgttcagctttatatacaccgttttcggtcgtgaccgttttcggtcccaccctttttttatatagaataattgtaaaatgttataagtaaaagtattggtatgtgtgcccaacctttttcggttgcacaaatttatggatgtagtattagtcactgtataacttacactaccagacagattcttgaatgcaaaagtagttatactggccaactatgctattaggcaagcaaaaacagttaaaactttatgcctaaaagcagttttattacaagggaggagatacgttggttgccaaactattgttgcagtgcacctggacaggatgatgactaactaaggtgcgccagtacgactgttactggtgccaactatgtgggtaactcaaggtaaaacatgtttttgctgaaacacataggttttaatactatctaaaagcaaatagtaccaacgaccgaaagcggtcgcacacaacccggccatacaaaatggccacacggtatagtttgcaaccataaatatattgcatataatgtaacacaccttagggtagggctacaaattatgtatgaaatgttgcagtcctattatatgtaaaacaaggacatatgttagtcacagggtgcaaccacaaaggacacggacatacatactttattaacaaaaacagattatacacacatacttgcaaacatacacatatacacatacacatacatgcacatacacaacataccaacaccaacatgacacatatacaaccacacagacaaacaacatacaaaacaagacatataacaattattttgacacacgtttacgtttgtgtttagaggtagatgtggtagctgcagtggcagtgcgtttacgagggcctatggtgggccgtctgcgaacacctgcctgtaacagaaatttgcgtcctaatgggaattggtccagttcagaactaaacttttcctttaaatccacattccaaaagttaagaccatcatagggatcttttttaacaggtgcaggggcgtccttttgacatg

SEQ ID NO: 95 - DNA, 8568 bp, Artificial Sequence
  Human papillomavirus 73XX double truncated plasmid
gatcccctgtttttctttctacaatggcttctacattaaaccatcccgtacacctcccttcccaattacctgaatcagccatcttcttttataggtttctggaacagttggggcacacaatacctagtgtacccataagcaactcttctatcactcttaaatcagctttgttgctttcaatggcaaggcatactgtgcactgacacttcgtgcagtcagtaactattctgtaacactctcgttcagcttgtctgtctagatggctgtctgtttcatcctcatcctctgagttgtccaatgactcgtaacatgtaaggtcaatttcggttgttggtttcaggtctaaagtaatgtcctgcaaggttgttttttttccatgcatcttacaccacagttgcagatggtctccagcaccgtgtacagcgtccggtccactgttctgctatttgatgaaaccgttttttttcatctacatgcttttgcttttccagtggacataatggtttttggcattttccgcaccttattaaaatattacataactgtttgttagttaaattttctaacgtagtgccatatactgattgtctatatcgcctatactctctaattttagaataaaattttaaacacggttgacatacaccatatggtttatcctttctatatacaatacacaaatcactaaatgcaaaatcatatacctcagatctgtacagtccacgttggcaaaacacacagtccaggtttatatcatgtatagaaatattcacttcgtcacataacgcttgtagcttgtatggtcgttcttctgaattgggaaacagcatttcccaatctgtagcgttttttgctttcctacttttatatgcaccgatttcggttgaaaccgttttcggttacacccttttttttaatagtacattatagttatttgtaataagaaataaattggcatttgtgtgatccaaataggtttaactttttaggtgcagtatgagtaacacgttattactcatttataaaacaattacttggcatttaaaaaacaatgttctgccaagagtacactgtgtacatagtataggtatgtgcttaaaagcaattttatgatagggtgggtaaaaaatgtgtgtgcaagacattgtttaaataattgcagacaaatgagtaactgccaggtggcgccttttacctttataaccttgcgtgggatgaacatgttaaggaaacaaaccctgccaagttgcctgcaggaagccaaaaacagtacaactattttgctacaacagcaaaacacattaaaacatgttttactgtgcaaccgaaatcggttgccctttttaccttaatgcatgtaaaatggcgactatacaaaatggaagcacagtagtcaagtaaaccacccacacaacacacatataaactttattaaacatacatacaaacattactacacatacacatacacatacacatacacacaaatacatacatatatataaacaaacagttatacacatgtacataaacatacacacagtattagtaaacagttaacatacaacaaacaaacatacaaaacacatgtaacatacaacaaacaacacatacacattacacttattaaatacgtttagcacgttttttcttaggtgtggcacttgtggtagcagatgcagaacgtttagaagcttgtaacttaggacgtgcacgcataccaagttgtaataaaaattttcttcccaaaggaaactggtctaattctgcagaaaacttttccttaagatctacatcccaaaaggatagcttggcatatgggtcctctgtttctttaggaggttgaggacgttggcaactaatagcctgtgatgttacatatctatatgtttcctctaaagtacctgacggtggtggggtaagaccaaaattccactcttccaatatagtagaattcatagaatgtatatatgtcattacctcagtagttaaactaattttacataactgaaaaacaaactgtaaatcaaactcttctgcatgtcttaaatattccttaaaattagagttggcatacgttgtagtagagctactagcctgtgtacctacacatacagaaaaattagtgcttctagtagtatctacaacagttaaaaataattgattatgccaacaaataccattattttgtccctgtgccttttgcaaccaataaggtttattaaacaactgtgcatctgaagaaaccatggaaccactaggtgtaggataaaaaacacaactggatggtgttgcagtattgcctgtgcctttaatcattaggtcatctgggattttatcaccggtatcaccagccctgttaaataagtgtcgaacaaacatttgttccctacgaagataaaaccacatggaatcaccatagggatcagcagccatgcctaaataatctgggtatttacaggtagtgttagaaatatcaataggtacatcacttttatttgcttgtaaagctttaaaatccatggctccaaagccaacatctatcatatcaccatcctgtataggggtgttctttaattccagtgggggacaatcaccagtattaacagtttgtgaagtacatggcgtgcctggaccccaatgttcccctaagggaggcctacaacctaaaatacacaactgtgtttgtttataatccactgacatacattctctaccatctgtattttgtccagcaatgtatttaggagcattttcagtatcatctaatttattcataaatggattgccactagtacctatacctaagggttgtccacgtccaacctccacaccagaacaggcccatactaggcgctccttatcaggattataaaaggatgcatctggaaatccaaatttattaggatctggtaaacgaagcctaaacaccctgtattgcaaacctgaaactttaggaactatggttttacgtttttgagaatccttgataggaaaatatgggtgtcccacagccaacaaacgtgtgctacctgcataataatatatatttgttcttgttacatattcatctgtgcttacaaccttagacacagacacagggggcaggtatacctttgcatcagtaggtcgccacatctcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgcccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgtaaaagaatatgacagacgtttacgtttgcgctttaacaaataataactagggtgtaatataaaacctgacccataaatatatataggaccagcaggctgtaatggcactattggtgtaaaaatagtttctgtagaaggtagtggtaaagcaatatctggaccaggatgtgtgtctaacccagtactaaaaggaatagttgtatttgcagttgcagtagaaatatcactactaactaaactattactatgtatacttgtaggtgtatatgtttgttgtagtacagtctcttctacatcattgtctaaaaacacatcatataacccatcattaatactactaccagttactatactaggtgtttgtggtgtaactaaaggttgcatttcaatatcattagtaggtataggacttatatcatgataaaaatgtactttagcacctatacgtttgccacttctagtagaaagtgttgcacgttgtcccaatctactaacacgtatgcctgttttatgttgtaacagatatttgtgtagtatcactaatagcagatacatctataatagcaggtgtactgtttacagaagttgtaatatcaaaccctgaagtagaaggcactatagatgtaggaccaggtatacctgactctataaaacttgattcttccactaatgaaacaatagaagaatctgaaggcccaacagacgtaacaactgatggtcgtataggttgtaatggaatttcaactggtttagatggtgtgcctgtagataatggaacgtatccagtacgcccccctgatccagacccactacctattcccaatcccccaaaaaaaactccaatactaccatattttaatatattatcagctatagtactaccttcaaccttgggaattacatcaggagggcacgtacctgcttgtttacatgttttatataattgtgttgcagatgcacgtttttttcgtatgtgtgtgtcacgcttgcgacgcatggtacactaaaaatattaggcagtttattatatatgtaaaattgtttatgttatttgtaatgtagcatggtaatgtacaagtgccataggaatataaaataccaaaacatataaaaaaaatacttttaacaatgattgtgatacatgtataaaggttattataatcaataccaataaccatgggtaaatatacacagacactgcaagcgacacacacaagcacaaacaaaagccaacacaaaacaaaaatacaaatatacaaagaatcatatatactgtgtaaccaatgttacaaagacatgtatcctgatgtaactacaatagtttgtggtatttttacatgttgtaaaaaatgttgttgttgcaatacagttgtaaacattaatgttattacaccacatttactatttgtagtattggtccaatgccatgttgttgttacatttttaaataaatgtgaatagcctttatgcaatctatatctaaaacattttaagctgtttttgtcaccttttaaatgcactattggcgcaacattatgtgtagtacactgggtacaggactctgtggtgggatgtaggttatgcaaacaatccaggggcctctggtccgagtcacactgtctttgccgtttccgtgatggcacaccggtgtcaacgttggtgcaggtggtggtggtgttggtggttgtggtgtgcagtgggttaacaatttcaggaatggatacttcacaggcgctagatacaggagcacaacatattacctgaccacccatatgtacttcccatatgccttttaccccgtaccgttttgcatctgtatcaaatcttgtatagtataccttttcctcatcatctgtttcataatatataccattataatctattttgctacctacctttgcccaccccccttcataccaacaatatatatgtgtccaaaatacatattgcatgctattgtccttttcacagtcatatctaacctctactgtgctagcaatgctgcttttgcattattcctttgtaataaatttgtaatatctgttataggtgtgctctctgtttctatatccatatttgaaatgctactggacccactactgctttcacgtggcgacacaatttggttgccttcttcattaacattttgtaaacaccctacccctgccccaagtcccggtacctctgtctcgtaagtttccacttcagtattgccatatccactgtcctgctcctcaaacagtcttcgtttagatgtacttctaccgctacttattgacaatacatttatttgtggactaagctgtttgtctatgaattcatctcttttcatatctgggctaccgccaggactacctgtaaactttcgttttagaacacgtatagcctcattgtctgcatttgcttgctgtgactgatacaatgcctgtgcaatttcctgttgtgcatatatatttggtatatgtgcattatcaataaaatcccccatttccgactcatctgtatcccctccatcataattttcatcctctggaattg

SEQ ID NO: 96 - DNA, 20 bp, Artificial Sequence
  Promoter sequence
ctcactatagggcgaattgg

SEQ ID NO: 97 - DNA, 6451 bp, Artificial Sequence
  Human papilloma virus type 33 truncated probe
  misc_feature (1)..(6451): n is u or t
cngnaaaaaaaananggaaaacgnnnacgccngcgacgnaaaanaaaanaacnaggangnaaaacaaagncagcaccgncnacaacaanggngncaaaaggaaaaaaaggcgaaanaggaacaaangggcnagangngggaaanaaaggggaaggnanancagggccagacanaacaggagnancaaanccngnannnaaaggnanagacacanngcnggnacgngnngnngcaaacgnacngnangagngnngcannggggngngnacannanccacancgncagcanaaacancanacaaaccancannaanacnanaagacgangnagaagnancangnaaaggcngnaanncananngnncannnggcacggngnggncnaaaggcacaanaggacnnaaanccnganaanaangnanncnagcnccaannngnnnaccacngcgagnnnnaagngnggcnnnnngaccnacncnacnaaaacgcacagnangncnacgagangnaanagcaggccnangnaangcaanaanancnagaaagncaggancaggagcaggngananancacnangnngaaanngnaangngncnncagggncaaagcnnncaaangcaggannancanangnnanaagnnnangaggcgangnnaaaaaagcagggncaacaaccnnaaccngnngggnanngcgacnananaaaccaaggcgngccacagggcgagacccnggaangggcgngcnngangnnacannacnacngncngnggaaacaacaaaggnanccannggnangnnnncanaacnnngngngcnaacagnaggggaagaaaananaaaangnccagaggcnncngcaggcgcnggagggngnagnacaganggnncagnaaangngggannnaaangngnagaaanagnnngaanagangacnccccaacagangaaacannaanaanngcaggngnagnancngcagangnagnaacancaaaaccnganggngnaggaanaganggggcnggngcaccngccncnanaaaacnngnnncnncnannaangacacnanagacgagncnaaaggnccaacagngncnacagnaaccggaggacgnanaggcngcaagggganngcagcngnaggngggncagnaccaanaggnacanagccagnccnnccaccngaaccagagccngngccaanaccnaaaccaccaaaaaaaaccccnaaacngccanannnaagaannngancngcnanggnacnnccnnccacnnnaggaanaacancgggngggcaggngccngnggccnngcangnnnggnanagnngngnngcagangcacgcnngcgccnngnagancgnnngngncncanaanaanacacngcnaaaananaaaggnannnannagnaanacaaaaaaaaaaaaacnaaaanaacaacaacaangnnaaaacaccaccangngcacanananacaaacaanananacangnananacannacncnngnngngncanangcngngcangaaaannaanacacancannggnaaananaaaaacaacaaanagcaaaaaaaaannnnnaaaggagancccacaaacacccaaagcagcaanaccaacaccngcaaccaagcanaggnagaaanggaaagnannaaaggacgnaanaanaagganaagcanaaaaacaananaaaacanaanacaaaaacaaanancanggnnananacaannagcagcacanannggcnngngangnacacnnanaangncanaaanccagnacnnannngcacagnaggnggnannnnnacggnaccnaaaaacannngnngnngcngnncagnnacaaangnnacagnnacaannccannnnnacnannnnngnngncacnggnccaangccaggnggangacanagaacnanacaacncnnnanaaggnnnnaancngnancnnaaacannnnaaacnannnganncaccnnnnaaangcacnanaggngcaacgnnaggacnacacacagnccgcngcnngnnngngcagnnagnngcagnacgngcngnncnanngnccaaggcggggncngcacagaacagcnnngnaaggggcngggcggngncngnggngncngcaggncgncgncgnnnggccgcngcnngnggnggncggnnancgnngncngncngnangncagcagnnncagnagngganannnggnngcnagananagacgnaggacaaacaannaccngaccacccacangnacnncccacannngngnnnnagaanacnnngcagcanccncnnnaaaanannnaaaananaccnnnncacagnnangnananaanacanaccnananaancnacnnncccngnaaccanagnacangnancnnccncnanaanananannncaccccagnnngnanaanccanngnannnnnnnngncanngncananngcacagnnacngnnncnccnngnnnnnnaaaacannnnggnggnncacaaagccacaccncnaagcnngnnngnngcaangnccannggcnngnacnanacngngannnacnnaangncnnacnaannccanaaaacnnannccanaggccncnnnaaannnananaananannngcnnnngnannacnacnangnagaacannacnaannnccngcaacgnaacannnncacagcnancnacannngncncacagcnnacnncngaancancccccaccccacnaganncnaagncannnaagnnngngncgccannnngacnnncnaccngnngnaccancngcngagnnnccacnncagnanngccananccgcngncnncnagcncancnannnnncgnnnncngnangngcanncnnnannnnnannaanagacgnncnacacgggnnngcagcacgancaacaacgnccnccgcagcacnnngngaacangcggcaaacnnncgnnnnagngcacacacagcannnaaancanccnccccnnccngnanannaaacaangcccgggcngccncngngncngccngnanacnannnnccanagaancancnanaaacncnagnaaanccgngccacngncancngcngnnncanccncancnncngaaanannancnccngnncnncncncnangacngcnncnaccncaaaccaaccagnacaccccancccagccccannngnaccnncaggancggccanngnagangangnnnanngnngngcacaggnagggcacacaananncacngngcccanaagnagnngcngnanggnncgnaggncacnngcngnacngnngacacanaaacgaacngnggngnnacaagngngacaacaggnnacaangnagnaancagcngnggcnggnngngcnngnccancnggccggnccaagccnncanccncancngagcngncacnnaanngcncanagcagnanaggncagnnggnncaggananaaancnaaaacanannccnnnaacgnnggcnngngnccncncanggcgnnnnnacacgncacagngcagnnncncnacgncgggaccnccaacacgccgcacagcgcccngcccaacgacccgaaanannangaaancgnnngnnnaaanccacangncgnnnnnnnncnngaggacacaaaggncnnngacananaanacaccnaannaanannncannnaaaggnnnnnnaacngnnngnncnaangnannnccananacagaanaannanaangncnananncacnaannnnaganaagaaccgcaaacacagnnnacanannccaaanggannncccncncnananacaacngnnaaancngcaaangcaaaancananaccncagancgnngcaaaggnnnnnngcannccacgcacngnagnncaangnngngnanagnngncnccaangcnnggcacaaancangcaangnncgnggnnnnnccncagngncnngaaacanagncgngcagnaccnnacngcaaaanggnngcnnnananangcaccgnnnncggnngaaccgcnnncggnnacacccnacnnnnnnaaaacnnggcannanagnnnacnannananaaaagannanaaangaccaanangaccnaaaacggnnagnccacaccnggnaanaaacaggnagngacncacnnnnacaaggcanagnnnggcanacaaagcaanngngnaagccaaaacngcacnnaaggnnngaaagnaaagnaaaaanangngccnaaaagcangngnaaacnannagnacaannaagnannnngcaanngcacngcangnananangagncaangcagcaagnacagacaaacacagngcaggaaagaaaaggannaacngnncngccaangncanagggnangnangccaangcagcaagnacagacaaacacagngcaggaaagaaaaggannaacngnncngccaangncanagggnangnangccaagnaaccgaaaacggnnaggcanacaaaanggaggaaanngnacaananggacacnagnangncaaaaggnaaagcaanacnaaacangnaggnacnacaaananagggaaanaaaggnaggnacanngcaangcagggnagggcaagcaanacaacnccnnacncananaggnacacccananacanaacanacanacaaanagnnnaacaaanacacacaangnnnnannaacananacacaaacaggaaacngacaagnacanagaacangcacacaaacaagnacacanaaaacaaacacagnaacanacaacanaacanacanngnaacacanacacaaaaaacaaacaacaacacaacacaacaacacaaagnacanagacagaacaaaacaacaacanaacacaannacacaaagngnnannnnnnaaccnnnnngcgnnnngcagacgangngcgggnggangngggggcngcacgnnnaagnnnaggnnnngcnnnaagaccngccngnaanaaaaacnngcgncccaaaggaaacngancnaaancngcngaaaannnnnccnnnaaanccacnncccaaaangnanannnaccnaaggggncnnccnnnnccnnnggaggnacngnnnnnngacacgnaanagccngagaggnaacaaaccnanaggnanccngnaaacnagcaganggaggaggngnnaaaccaaanngccaancnncnaaaanancngganncanagcangaananangncanaacnncngcagnnaaggnaacnnngcanagnngaaaaacaaacngnagancananncnncaacangncnnanananncnnnaaaannnncannnnnanangnacngncacnagnnacnngngngcanaaagncanannagnacngcgagnggnancnaccacagnaacaaanaccnganngccccaacaaanaccannannangaccnngngcacgnngnagccaananggcnnannaaanaacngaganncggaagnaaccannganccacnaggagngggaaaaaaagcacngcnnngaanagaggcagnagnnccngaaccnnnaangnacaggncancgggaacagccncnccnaangnaccagcccnannaaaaaagngncnnacaaacannngnncacgncgaagaaagaaaaanaaacnancaccanaaggcncacnagncannnnnaaanaancngganannngcangnacngccacaaanancaanaggaacancacnnnnannagccngcgangnnnnaaaanccangcaaccaaanccngngnccaccanancaccanccncaanaanagnannnanaagnncnaaaggnggacaancannggcaggngcngcannagnacaagcaacaccnnnaccccaangnnccccngnnggaggcnnacanccaagnaaacanaacngngnnngnnnanaanccangganaaacanncccnannancagcacccggnngnccagganacnngnnaccggnnncagngncancaaannngnnnaanaaaggangaccacnnangccaacgccnaanggcngcccncnaccnannncaaggccnacacangcccanacnaancgnngngnancagggnnanaaaaggaggngncaggaaanccaaannnannaggancnggnaaacggacccnaaaaacccnananngcaagccnganacnnngggnaccaanaannnnnnagcgnnagnaggannnnnaanagaaaaanangganggccaacagcaagaagncnggaacnaccagcanaanaanaaangcnngngcgagacacananncancagngcngacaacnnnaganacaggnacaggaggcaggnacacngnggccncacnagaccgccacacggacanc

SEQ ID NO: 98 - DNA, 5952 bp, Artificial Sequence
  Human papilloma virus type 39 double truncated probe
  misc_feature (1)..(): n is u or t
  misc_feature (1)..(5952): n is u or t
cngaaaaaaaanagggaanacgnnnccgnnnnnnnaggaaaaaanacaanaanggcaacaaanaanaannggaacccngaanggnnanngcanangnngngncnannggnccagaaggcaccaanggcaacngnggagnagnacnnggnaaagcaanancaggaccagnannnacaggcanannccangaggnacnaaaaggaanagnngnannggcanannnagnagangcngaagaagccacagaaggnagngagccngngnnanangnagngcccgaancccnngnannannaaangcagnancnaaanangngnnanngnccacancagcanananancaaanaangcancngaagcancagagggcncagcgngaacnaggggcngnaanncaangcnnncagcaggagcaanacnacnaangncanggnaanaangnacnngcgcnccaannngngngccacgccgggnaaccanggnagccnnnnngccaagccnacnaaaccnnacngnnccnnnacgcgaggnnaaggcaggccnangnaaacgaacaangnccagaaaanccggancnggagcnangncagcagcnncanangnnaangnagnancaacaggcncaaaagcaggannancaaangnnacaaangangaagggngagnnacaaaancaaaannacnaacacgaaccngcngangngcncnacnananaaacgnggnccngccacacgacngannccaggngnaggngngcngcnaanaggnncggnaccngngccangngnggcaaacacnnccanaggnannnccncanagccangngnaccngangnaggggnacngacaaananannacccgaggnnncaccngnnnggggaaccncaannaaggaagganccgnaaaggcagggnnagnanaacnagnagaggnnannngnacagacccagaggagggngnaananncaanaccgcaggcgnagnagnagaagaagaagnaannncaaanccagaggngccngnaaangnnggnacnggngnnccagaggnnanaacacnngagnccnccaccaanngcacaanaganggcncagaaggaccaacaggnncaanagcnacaggnggacgngcaggagacacancnacaacagnannaggccnaccccccaggggnanananccngngcgncccccagnaccagnaccngngccnangccnaacccacccaaaaananaccnaaaccagnccacngnaaaannnngncagcaagngnagnacccncaacnnnancaacaacgncnggnggacaggnacccganngnnnacaggnncnananaggncagnngcagangcacgcnnacgccnggcagcacggngggaaaccangnnnannagnaacaaaaaaaaananaaaaagcnangnacagnagnnangcacaangcacanacananacagnacnanancananccanngccagncnangcaacaaccacangggcaanacaaaaaanagnaaananacaaaaaacaccnccaanggngnggnacgnanaagaanaaacacaaacacaannanccacacanacgcacacacangcacagacggcaaaagcgggacanngcaacanananananacacacaccaaaccacaccaaaaanaccaanaanancancnangnagnangnanacaananacanacacaanacccanagnanacnnnacaangncangnaacccaangaaacangnacacnagaaggnannnnaacagngnccagaaannnnnggcgnngngacncngnggcanangnaacagnnaanangccagcgnnnnnggnncccnnaccccgnanccaangccaggnacangaaanannnncaaacaangngncanannnnngnagncnanancnnaaacannnnaaaccannnnngncaccnnnnaaangnannanaggcgnagngnnaccacaacngaggnaccgncnngngnngnggccngnacngnnacngnggagngggnngnnaaganggnccagggacacnccgncgggcncagngggcncngngacngcacacngncgaggncgcnnncgagacggcggcggganngnnnnnngggngcanggggnngnngcggnggaangggncgcggnggngnnnganaanncggnagnaagnnannagcannaaaannagnacnccnngnnnngngncnaagcnnngnanangngnananaaggcanannngnngannaangnnnnaaanccnncngcaanagnnggangnacnccaaananggcngccacccagncngnacangnngnnnnancacnnnnaaacgnacgnaccaggncagnaaagganagnccanangnnncnnnaaanngngnnagcanngcagccnnnnngnnanngganngnaacaanaannnaannngngcagnnggagannnggganccnggnnnncacnancnanagcacnanccacacnacnacacnccncccgnacacngccgccangnnccccnncagcanccccannngnannagnngcnacagnnaccnccnccacnncagcngnnnccacnnccananngccananccgcngncnggcacggaanacaccgnnngngnngccngcgnacngcnnacannnaangaaannnccngnagngnnccccnggnannccngccnacnnnnnnnccanacggncnagngncgccacngcngncngnanacnnncgnnnnaaggcacgcacngcnngngcancccnnngggccncnngcanangnaaaagnaccngngcngncncacgcncngccngnacacaaanancngnggaancancaanaaagncngccaggncngaaccngnancngnngcannnncanccncanccnccgacacngngncgccngnnngnnnancnacnanngccngnacnagaaaccanccgnnacancccgacccanccccgncngnaccnncacgannggccanagcaggnnacnggnnngcagnngcacaccanggacacacaaanccnagngagnccanaaacagcngcngnagnngncgcagagnancccgngaggcnncnacnaccagcngcagngngnngnnacacnnacaacacgaacacngcanngngngacgcngnggnncancccgncnggcnagnagnngangnnggngannaacngcanggncgggnncancnannncanccncngacncnccnaanngcncgngacanacaaggncaaccggcngnannncanngnaaggacanaaancnaanacaannnccngcaaggngggcnnnggnccacgcanancngangnnanacnngggnnncncnncgngnnagncngcggnccncccgnnnngnggnccagcaccgncgacacngnccngnanagcnnccngcnannnnangaaancnncgnnngcnannnaggngncnnaannnnncngcnggacacagcggnnncagacaacacangcaccnnannaanaaannananaacnnngnannagnnanannnncnaangnagnngcanacaccgagnccgagnaanancgnagcncccgnannnnagcanaaaannnnanacangannggcangcagcnagnggnnccccgncccnananacnacananaaancacnaaangcaaanncananaccncggnnngcngnagnggncgncngcaanagacacaggcnanngnaangnccngcaaggnggngnccagcgnngngcacaggncnggcaannngnanggccgnncngcagganngngaaancgcgccancggnanggacagaaacngngacngcgnnnnananccaccgannncggnccngaccgnnnncggnnacncccnnnnnnnaaacaaganacnnanaaaangnnanaagnaaaagnanaggnangnangcccaaccnannncggnngcanaaacnanngngngcnacannagncacnngnanaacnnanacngnaagacacannccngaancaaaaagnagnnanacaggccaacnannnaannaagcaagnaaaaacagcnaaaananangccnaaaagcagnnnnannacanagggnggagananggangnngccaaagnanngnngcagngcaccnggacaggangangagnaanaaggcgcgccagnaaaacngnnaccagngccaacnangcagggngaaccnaaggnaaagacangnnnnngcngagaaaggnggnnnccacnagnnnaaaaaaaangcncaacccacgaccgacnncggncgccacaaaanggcgaagnanaaaangnagaaacgcgnacaacaangnaaaaannacanannaggnagnaaacacaccnnagggnagggcananagannangnangaaangnngcagaccnannanangnaaaacaaanacacngnnagncacagggngngcaancacacangaaacngncanacanacnnnannaacaaaaacananacacacanaccnacaaacanacacananacacncaacacanaaggaaacaaacaacanacacacacanaacaaggcanacacangcannannnagacacacgnnnacgnnngngnnnagnagcngaggacgaggaagnggangcagcaggccgcnnncggggaccnanggnagggcgccngcggacccnggccngcaacaaaaannnacgncccaaagggaanngancaagnnccaaacnaaacnnnncccnnaagncaacannccaaaacnnnagaccgncananggancnnncnnnncaggngcnggagcanccnnnngacangnaanggcngcagacngnaggnancngnaagngncnaccaaacnggcaganggnggaggagcnacagcaaaannccaanngnccaananagaggaanncanagngngaananaagacanaacancagnngnnaangngacagnacacagnngaaananaaanngnaaancanacnccnccacgngccnggnanannccnnaaacnnagaaggancanangnagaaggnanggaagacncnanagaggnaganaangnaaagnnggnacnacgggnagngnccacaacagnaagaaanaanngannangccaacananaccanngnngnggcccngggccnnangnagccaanaaggcnnannaaanaacngggaancagaggnnaccanggaaccgcngggagaggggcagnanacagaacnaccggggnnngcacgnanancngngcccnnaananacaanngggcaggaanggcgncacccaccnancaancanancaccanccncaanaggggngnnnacnagnnccaaaggaggacagncccccgnaganacannanngggcnngcangccnnncccnnaccccagngcnccccaanggcgggaacacagccnanaangcacaacngngncngnnnanaanccacagacacannancccnacngnccnnannggnggnngangaaaanggngagnnnncagnancanccngncnannananaangggngnccacnaanaccaacacccaanggcnggccccngcccaccnccaccccnacacaagcccanacnaaacgnngngnnncnggannananaaggangcancnggaanacngaannnannaggancgggcaangncacgcgaaanacccnanannganangcagacaccnnnggaangnccngcnngcgaccaccanncanacccacnnnaaaananggangnccnacngnnaanaancnagagcngccagcanaanaananangccngngcgngnaacanaancancagnanngacaaccnncgccacagaaggnggaggcaaanacaccangcngncacnagaccgccacanagccanc

SEQ ID NO: 99 - DNA, 6561 bp, Artificial Sequence
  Human papilloma virus type 52 truncated probe
  misc_feature (1)..(6561): n is u or t
cngnaaaaaaananggaaaacgnnnacgccngcgacgnagnaaaaaanaacnaggangnaaaanaaaancngnaccancaacaanaanagangnaganggagcngnaggggcnanaggaacaaaaggagnangngngggnaacgaaggnaanggaangncaggaccngacncaanggacanagngggnngananacaaagncaanaccacnannaanaggnacagngaaagnannannangggnagaaagngnggaaggnaagngaaacgngggnngcngcaaagaancngcanacacancanacaaaccancannaanagngnaaggggacacagacngnggnaanaaaggnngcaanncnangncnnccngaacnncagcaggcngganaggacnaanancanganaanaangnacccgngccccaannngnnnnccacnacgngnacgnagggnggccnnannaccaagccngcnaaaccnaacagnaccncnncgagaggnnaangcaggccnangcaaagcnanaangncnaaaaaancagganccggngcaggnaaaagnngngaacgancaaaaannanagnnncancngnancaacgcccncaaaaacagganngnnanangnnacnaannncngnggngangacanaaaagcagggncgacnaccnnaaccngnngngnggcacggcnananaaaccaaggcgngncgnagggcgagacccnggaanaggngnacnacnngnnacacngcngcngncagnagaggnaacaaangnanccanagggannncnncanaggngngngnacnaanagnnggacnagaaaacaanacangaccagangcnncngcaggngccgggggcngnannanaganggnncagngaangnaggannnaaangngnagaaacnganngnacaganganncaccnanagangnnacannaannanngcaggagnannannngcagangnngnaacancaaacccngnngcnganggaanaganggagcaggngcgccagacncaanaaangnngnnncnncnancanagaaacnanaganggnncnaagggaccaangggnncnacagnnacagggggacgaanggnggacgnggnaanacnacnagngggaggacgagnggacaanggcacanagccngcccnaccaccagagccngcaccngnaccnanacccaaaccnccaaaaaacaccccnaggcngccanannnnaaaagnngancngcaanagnngngccnnccacnnnaggaanaacancgggggggcaggngccagaggcnnngcangnnngananagcngngnngcagaagcacgnnngngccgngnagaccgncngnancncanngcgacaagcnannaaaaaananaaaagnannnannagacaaacnacaaaagngaaaaagnanannnngcananangcangnagccaancnacangnacagnnanngcagnngngccaaanacngngcangacagngaanacaaaacannggaaaananaaaaacagnaggnacaaaaaaaacacnnnaaanggngacccaanaganacccanagcaaaagcaccagcaccaacaccngcgcanacaccgananaganagcaagagcggccnaagcacngcacaaaacaccanaagcaaaanaaaacaaaanacaaanaanccnaacanngnnanananacacaanagcagcaanannggcnngngnngggngnnnaccanacacananacanananacanangnacaaanancacaangacangacaccnngnanaacnngcacagnannnggnannnnaacagnnnnnaaaaanngnngacgnngngnnncancacngnacgnnanngnnacaanaccnagnnnannannngnacanncannacnggnccaangccaggnagangaaannngaacanacaaacnnnnangngnnnnnacccnanancnnaaacannnnaaacnannaggancaccnnnnaggngnannanaggngcagnacaagnngnangngcaacccgnccnnngnnngngcacncagnngcagngacgagnccccgngnagnacngnccacgganngnngnccccgcaaaaggnngnnggggnacnnggngnnncnggagncngngacgncnggncgncgncgnnncngnggnggnngnaggngngngncnnnggcacccacggacacngcggaggncnnggaggnnncggngcanaggnggacagcagnnncagnagngganacnncgnnacnaganacagangcaggacaaacaannaccngaccacccacangnacnncccanacnccngnnacacaananngcnnngcancgnnacnaaannnnacaaaananannnnnncnccancacaccaanaananaacccanagnaancnacnngnccnncnacaanngnacanncacacncaccaagnaaanaaannnccnnccanangngnnncnggnanannnaacagcngngacannagnnnggacacngnnaancngnnnnnnccacannnaaaccnaannagcagcagnanaagcacgccncngncacangnnaaacanngcaaangggcananangcnanagggcngnannaanacnnnnaanccnncngcaacnganggngnnacncccannccnanaanacaccaancngnacaacnacnncnannacnnnnaaanggncnnacnaannccanaaagcnaacaccanangnnncnnnaaannnaaanaanacagnngnnnnnangcnannnncgcacanaanannnngnangcnnnnnagcgnncnannacnannnnccncanngnccncnanacnagnacaacnnacancngaannacnagcccccaccccacnnganngacnacngnnacnnngccagncgccannnngcccgncnaccnggncngccancngcngcgcnnccacnncacnanngccanagccgcngncnncnacgngacanggnnngcgnnnnggnaaaacacacncngnannnacacaaangngnnnngcacgcggacnaccangnnnnncnacaccancnngcccagcacnnnccggacngcnngnaaacnnncgnnnnacngcagacacagcangnaaancanccnccccnnccngngcannaaacaangcccgggcngccncangnncngccngnncannannnanannngaancancnanaaaancnannagancngnnccacnancanangcannnncanccncgnccncngaaangnnancnccngnnngnnnnncnannanngccncnacnncaaaccagccngnacancccncccnnncgcccncngnaccnncagggnccnccanngcagggnngnnnanagccgngcacagccggggcacacaacnngnaangngcccaacagcannngcngnagagnacgaaggnccgncgcagngcnangaangcanagccgnagngngcnancacaacngngacaanangncacaangnagnaanngcnngnggcnngnncngcnngnccancnggccggnccacaccancngnanccnccncancngagcngncaccnaanngcncanagcagngnaggncagnngnnncaggnngcagancnaanananaancnnnnanagnngcnnngncnccacgcangacgnnacacnngggncacaggncggggncnccaacacncngaacagcgcccngnccaacgacccanaanannangaaancgcnngnnngcannaacangncnnncnnnnncnncaggacanaanggcgnnngacaaannanacancnaanagnnannncacnnaanggnnnnnnnacccncncnncnaangnnnncccanacagngaanannganaangccnananncacnnancnnaganaaaaagcgnaggcacanaanacacacgccananggannanngncncnananacnanncgnaaancngnaaanagaaacnngnanaccncncnncgnngnagcncnnnnnngcacngcacacacngcagccnnannncangcaccganncnnccagcaccncacacaanncgngcagggnccggggncgngnngcngganccncaaacanggccgngcgnnagcnacacngngnncnananananacaccggnnncggncngaccgnnnncggnnacacccnannnnnnacnagnanaagannanaannnanaannanaaaaaaaagnggnngngggnacggnaaccgnaaccggncgngnagngcacaccnggngagnaacagnannnaancangnnnnacaagacanannnggcgnaggangnacnngngnaagccaacacngnaannagngcanngaaagnnnaaanaaaanangngccnaaaagcagnnnaaaacangcaangnnaggcaangnanngnnnagcngcacngcaggaccngngagncagcaagaagncagnnnaggcgggacaacaagngnagaccagnggacngcaggaaaccaaaggannaagcagnnngcngaaacnnananaaaaanagnngnnacngngccaaggacaaccaaagnngngccaagaccaaccgaanncggnnaggannnaaaanggngganagnacaaaanggnacaaaanggagagnanaaggcnaannagnagngnaacaaagnaggacacagggnagggcaggggacacagggnagggcaggagangcaanagannaggagcaacngnanngnnacncangngggngcaaccanaacanaagacnacnanaaanagnnnagnaaanacagnacnnnannaanacanacacaaaacanacanacaggaacngacaaanacaacaaacangcacacacanacanaacangcaaacaacacagnacacacacaaaacaannacanaacaaacaanggnnaccnnnnaaccngngnnngacanacacaacacanacangacacagacaannacccaacagacaanggnnaccnnnnaaccnnnnncnncnnngnggaggnacgnggggccgangangcagggcgnnnnagnnngggccnagccngnagcccngccngnaacaaaaacnnccnaccnaaaggaaacngancnaaancngcagaaaacnnnncnnnnaaanccaccncccaaaacananagnccnnnaaaggancnnccnnnccnnnaggnggngngnnnnnnngacaagnnanagcagnagaagngacaaancngnangngnccnccaaagangcagacggnggnggggnaaggccaaanngccagnccncnaaaanagnggcanccancnnangaangnangncanaacancagcngnnaangnaannnngcacaanngaaaaanaaanngnaaancaaannccncgccangacgaaggnannccnnaaaannnncannnnnanangngcnnnccnnnnnaaccncagcacanaaagncangnnagngcnacgagnggnanccacaacngngacaaacaacnganngccccaacanangccannanngnggcccngcgcacgnngnaaccagnacggnnnannaaanaannggganncngaggnnaccanagaaccacnaggagnaggaaaaaaagcacngcnnngnacagnggcagnanngccagagnnagacccnngnanananaaancaccnggcacagggncaccnaaggnaccggcccnannaaaaaagngncnaacaaacannngcncacgncnaagaaaaaagaacaaacngncaccananggcncgcnagccannngcaaanaancngganacnnacanacacngcnacananancaangggcacancacnnnnacnagcnngcaaggnannaaaanccangcaaccaaanccngnancnaccangnccccanccngnannacacngnnaangagcngnaggggaggacaanccccaggannnccngaannannannacaaggggnncccnnaccccaangnncaccnanaggaggnnngcanccnaaaangcanaacngagncngcnnanaanccanaganaaacanncccnannancnanaccaggnnnaccagcanannngnnacnggnnncagnancancaaacnngnnnaanaaaggangcccacnaanacccacaccnaaaggcngnccccnaccaannnccaagccngnacaggcccacaccaaccnnngggnnncngggnnanaaaaagangnancnggaaaaccaaannnannagggnccggcaannnaanncnaaanacccngnanngcaggccagacaccnngggaacnaaaacnnnnnnaccannaccacnacnggngnnnnnaanagaaaaanagggangnccnacngnnagnaancgagaacngccngcanaanaanagangcnngngcgagacacanacncancagngcnnacaaccnnagagacaggnacaggaggcaggnacacagnggccncacnaggccgccacacggacanc

SEQ ID NO: 100 - DNA, 5662 bp, Artificial Sequence
  Human papillomavirus type 56 double truncated probe
  misc_feature (1)..(5662): n is u or t
cngcaaaaaaanagggaanacgnnnacggcgccnacgncnaaaaaaanacacaggccanaangcaaaggaggancccngnanananacancangggnaacancanaaggagacngaggaacaaagggccacgnacnggggccngnaggcaacacnangncaggaccngaanaaaanggngnnncccacacannaccnaaaggggcagnnacannagnggngnnacnagcaaaagacaangnggaaggcnnnanaggnaagngngcagaaggngnagcaacngacnggcnagacaaaccaggngcnncancancnanannngcanaaanancananaggccancaaangaannannngcagacaanaanggcngcannncaannnccncagccngngcaanaggacnnanancanaanaanaangcacacgggcaccnannngngngccncnacgngnnngnanagnagccnnncngccaagccnacnaaaacgnacaccaccccnacgngnagnaaangcaggccnangnaangcnacnananncanaaaancagggncaggagccacacccgacggagaaaaagcnaaagangngncagnaccnncaaaaagnggannancagcaganacnaangnngcaggncnancaagaaangcagggncagnnaccnnaaccngcngaaangcnnnncnananaancnaggagcngcaanacgccnaaagccnggaanaggagnacnacnaanaggnncngnaccagaaccgngaacagcaaangnnngcanaggnannncnncanagcnangnanaccagangngggngngcnaannaaaananngccagacaccncgccngnnngnggggccncaanaacagggggancaanaaanaacggannggnnanangggnacnacngacangnacagnacnagaggnnggngnaananccaacacggcaggngnagnngnngangaggangnaannncaaancccccagacccagnaaaannaggaancccngcaccaganncnanaacacnggacnccncaacnaangnaacaanggaagggncngnaggcccnacggannccacaacaanaggnggncgcgccggagnnacancaacnanngnggaaggccnagaccccaanggaacanagccngcacgacccccagacccagnnccngnaccaangccaaggccnccaaaanangnaaanaaacnnccccanngcaanannnnancagcccangnnnnnngcncnannnnannaacaacanccncnggacangnaccagacaacnnacangnnnnananagnngngnngcagangcgcgnnngcgncgngnggcacggngggcaaccanagnagnaacagnacnacnacannnacanannannnannanccacaaagcangnaaanananacacagcacaggacagnaaaaaaanancaaaaanannanaaangnannaaaaaaggangnggcnanaacaaaccaaaacaanannannaanaananacaacnggaaaacacagaggcaganagcaaaagcgggacaacangacacacaagcaaacaaacacaaaagcaaagcgcaaacacaccaanaacacaaaaancaanggnngcaanananangcgnagcagcaangnanggcaggnacacnncacgnannngngngnnacaanaacacaaangnananacaanananacagcacnnnanggaaaacncannngncccaaacnaaccngnacacnacngggaannnnnacangacnnaaaaagcngnnncgnngngnnncanccnnanananaanngnaannangcnanaannnnnanngncngnacnngnccaanganangnngangnnacanccacaaacaangnnnnanannnnngaaancganancnacaacannnnaancngnnaggnncaccnnnnaaangnacnacaggcgnagncnnancaccagggnggnngnngnngnnganacnncnacnncnacngncggnanngncngngncgcngangngngngngngnngngacacacnnngcgngggacncncnggaggagncaaanncnganncccgnagncngggncgnnnnccnggncngnggganacngcggcgncnnggnngcccacggnngnaaanngcnacnnnnaaacaagnccngcaanngnngngnnggcgnnncanngnnncnancaananccanangnannacagagnccncacnanngnnacnanaggnacngnnnngngagccnccannnngngnanncccgcacccacgncccngnaccncnncancnaccngnncnggngnnnccagagnnnccaangnanngccanacccgcngncnngnaggncnganaaaanaagccnccgnnnnacnccnncccggcacacagnnngcngannacnaanancccnnaanggacnagcnananacnnncgnnnnagnnnnngcaacgncngnnnancngcangngcngnnngnacnngcaacaanngnngacngnnncngcgncngccngnanannnngnananangaancgncnanaaanccancnaaancngnancnannncanccnccncgncacnnncancancnganannnnancnccngnnnnnnnnncnacaanngccncnacnncaaaccanccacaacancccnnccccnccccancngnaccnncaggngacgccanngcagnnagnnacnngangcgcagagngggcacgnnacngnnaacgcacccanaagcagcngnngnacaacacgcaggnccncnnnggnacncngaangnccaacngcaccacaaacnnacacncacaacaaggnacgngnannaggnaacacgnangnngnnnagcnngncnagcnngcngnggccgcnccngcaaanggncnacnncanccncanccncanccncngagcngnccaanngcncanngcacngnaggncaannncngnnngaggngnnagnncnaanacaacgncnngcagcgnnggnacnnnaccangcangannanacngnaganncncnaggnncncnagangnnngncnccagcaccccaaacangacccggnccaaccangngcnannagangaaancgncnnnnncngncacaangcaanngcnnnnccnccggagnnaacggacnnngacancngnagcaccnnannaanaaancacanaacngnnnnnnagnnanacnnncnagngnagcnccanacacngaanagncanaanaccnanannnncnaacnnnacnanaaaacaanaaacanacncngcacacngcanaaggaaaancancccnanacacnaannnnaanncagngcangcaaaannananaccncagcacgngnnagnncnnnnnngcaananacacanganaancnaagancaannaaaggnannncnaanaccncacncaagnggngcaggcnncgnggacgnnccngngganngnngaanngnggcnccangganangnccacacagaanaagcngccnnnnanangnaccgnnnncggncnnaaacccnnnncggncacncccaanananaaaagnanganngaaacnnncaacaannaaaagaaaccngnnnnngcacgaccgnaaacggnnnnaaaaaangagnaanngnangnnacangnnngcaaaacaganacngacaganacnnggccnacanagngnanncngcaagccaaaacaccaaagnngcagacacangnanaaaaangngngcccaacagcacnaaagnangcaganaaaagcanagnnggcagncanagnaccngngagnaanacagggngcggnacngnacanaanncaagnanaaaacacaggaaacggcaanangccaaaggannaacngnncngcngaaaagggccnnnnggnnnaaanaanggcacnaggccangcaaccgaannccnnnnagnnnaaanaanggcacnaggccangcaaccgaanncggnngcangnacaaaanggcggaaaaacaacaaaanggagnangnnanggnanananangnangcacaanacacanagnacacngnacacaanaacnnacaaaacaaaagccacaanaangacacaccnnagnnnangcaaccacgcgnaaaagcacncanncangnnnannacagacacacaaacannacacanananacagncanacanacaangaanacacacacaaacannncacacaaacacaacanacacanacaaagnanaaaanaaagcacanacacaaacanaccanananacaacacacaaacacagnnacacaaacacacaacaacacacnaccgccnnnnacgnnnngcnggngnagaggnggaggnaggagcagancgcnnnnnagaggnagcnacagcaggcnnngaccnagngcccagnngcannaaaaannnncnacccagnggaaannganccaggncngnagaaaaacngnccngnaagnnaacancccaaaannnananngnaanncanannccnccacangncnaaggnacngannaannnnncgngcancanannnacnnaacngnncngnagcagnacnaanagncangnnagnacnncnagnagnancnacnacagnaacaaanaanngannaccccagcaaangccannannanggccnngggcacgnngcaaccaanaaggnnnannaaanaacngngccncagacgnaancanagacccacnaggcgnagcaacananacagaacncggagggggnncncnaccanngcnacccnnnaaananaacncngcaggnanngnnnccccaacnnnaccagcccnannaaaanaangncnggcaaanaanngnncccngcgnaagnaaaaccacanagaancaccanaggcancngcagacannnnnaaanagncagganannnacaggngganngnacaangncnaaaggnaccncagccnnagannccngcaacaccnnaaagnccanagcgccaaanccngngncnancangnccccanccncnanaggngnannaannaangcaagaggcgggcagnccccngnggnaacnngngnggacnnacacacagcaccnnnagnccaangnncacccanagcgggagnacanccaacaanacacaacngngnnngcnngccancaacnganananngncccnacnancnncnanaacannannannngcnaaannggaacnnncagnancanccagccnannaaacaangganggccacnnagcccagcaccnaaaggcngnccgcggccnaccnccaaaccnacacangcccacacnaaccgnnccnggnccggannanaaanannagnancnggaagcccaaacnnannagggncgggcaaccgnacccnaaanacccnanannganangcacnaacnnngggaangnnngnnnnggnanngnccnnagncacagagnaanagggangnccnacggcaagcaancgngaacngccngcanganaaaananacnagngcgnnnnacanaggaanccgnngccacaaccnnngaaacaggngnnggaggnaganacaccnnannnncacnaggccgccacgncgccanc

SEQ ID NO: 101 - DNA, 6546 bp, Artificial Sequence
  Human papillomavirus type 58X truncated probe
  misc_feature (1)..(6546): n is u or t
ncngcaaaaaaananggaaaacgnnnacgncngcgacgcaaaanaaaanagcnagggngcaacanaaaancagcaccanccacaannanggnannaaaaggagnnagnggagananaggaanaaanggacnagacanagangnnacagaagangcaangncnggaccaggnnccaangacacaagaggagngncaaanccagnannnaanggnanggacacannacnggnacgngnggnggcaaaggacgnangngagngcagaggacncngaaaancangnanagnancagcancgncagcanaaanancanaaagnccancannaanacnanagggagaaacagaagnannnaaaganngnaanncaaanngnngcngcngnngnaccngnnccnggacaggcngnangggacnnaagncnnggnagnaangnacnnnagccccnannngcnnnccacngcgagnacgaagngnagccnnnngcccaacccnacnanaacgnacagnaccccngcgagaggnnaangcaggncngngnaangcaacaanancnagaaaancaggancaggagcaggcganangncacnangnngaaacngcaangngnccncagggnnaaagccnncaaangcnggannancanangnnacaagncnangaggagangnnaaaaaagcagggncaacaaccnnaacnngnngggngnngcgacngnanaaaccaaggcgngccacagggcgagacccnggaangggngngcnagacgngacanngccacngncagnagaaanaacaaaggnanccannggnangnnnncanaacnangngngcnaacagnaggagaggaaaanannaaangnccagaggccncngcaggngcaggagggcggagnacgganggcncagnaaaggagggannnaaangngnagaaacagnnngnanaganganncnccaanagaggaaacannaagnanngcaggngnagnancngcagaggnggnaanancaaaaccaganggagngggaannganggggcnggngcaccggcgncnanaaaacnagannccncnannaaaganacaanagaagaanccaaaggccccacagnancaacggnaacngggggacgnangggcngnaaaggnanagccncagacggnggggnacnaccaaggggcacananccagnccngccaccngnacccgacccngnaccaangccnaaaccnccaaaaaacaccccnaagcnaccanancgnaanannngancngcnanagnagngccnncaacnnngggnanaacancaggngggcaggngccngaggccnngcangnnnggnaaagnngngnagcagangcacgcnngcgccnngnagaccgnnngngncncanaanaagacagngcnaaaaananaaaagnannnannagnaaangnanaaaaanaanaaaaacaacacacacaacagnaaanannnacaanaccanaccaccangngcagaaccagnanacagnnagncnngnngggnnaagnanngngcangaaaannaanacacancannggnanananaaaaanannaagnaacagaaaaaaanncgnagagccgaccccacagacacccaaagcagcaacaccaacaccagcaaccaagcanananagaaanaganagcaccaanggccgcaaaaaaangcacaagcanaaaaacagnanaaaacaaacaacaaaaanaggnaanancanngnananacacnnagcagcacanannggcnngnggnnnacanacagnaanngnacaanacaannacaangacanaacaccagnacnnannngcacagngggnggnannnnaacagngnnnaaaaacagnngncgnngngnnnccgnngngnangnnacagnaacaannccnacnnngncaccnnngncancacnggnccaangccangnggangacanannacagnanaagncnnnaaanggnnnnaancnanancnnaaacannnnaaacnannngggncaccnnnnaaangcacganaggngaaacnnnagaacnacacacgnnccgcccnnngnangnacagnnagnngnacngngnagnccnccnccncgnggncnacngnccacggcgcagncngnanacnnngnggagnacngggngnngncncnggagncnggnaaancgagncgncgncgcnnngnccccngngnacnnncgnngnnggnggccncggnggncnnngggncagcagnnncagnagngganannngancacnaggnanagangnaggacanacaannacccgacnacccacangnaccncccanaanngngnnnnagagnacnnnnnngcanccncnnnaaaanannnaaaanacgncnnnncanngccangnananaanacaaccccacanagncaacnncnccngcnaccaaagnacangnngnnnccncaanaanananannncacnccaannngnanaanccanngngnnngcnnnancanngncananngnacagnnacngnnangccnnnnnnnnnaaagcannnnngnggcncnganaaccacacnncnaagcnngnnngnngcaangnccanncancngnnnnananggngangcannnaangncncnaangccannngcagnncaannacnngaaacgcnnnagncnnngangcnaccaangacggcaccaccnggnggcacaaangngananncccannngncnggcngnanacannanagcacacnccangcgnannagnnnccaangnncaanaaanggncnaacnaannccanaaaacnnacnccanaagcnncnnngaannnananaanagcgnngcnnnagnannacngnnangnagaanannacnaanannnngnaanggaacagnannacaacngncnacanccgnnncacngcnnacancngaacnagcccccaccccacnagacnccgagncannnaagncngcgncgccannnnggcnnncnaccnggngngccancngcncagnnnccacnncagnanngccananccgcngncnncnagcncaanaannnnncgnnnncngngngngcanncnnnannnnnanannnccacganacacacacannngcagcccggnccacacagnccncnacagcacnnncngagcangcngcaaacnnncgnnnnagngcacacacagcannnanancgnccaccccnnccngnacannaaacaacgcncgggcngccncngcnncngccngngnagnacnnngnacngaancancnanaaacncnannaaancngnaccacnancgncngcngnnncgnccncancancngaaanannancnccngnncnncgnncnannaccgcnncnaccncaaaccagccagnacagcccgccccnaccccgnnngnaccnncagggncanccanngcaganggngnnnanngcngngcacagcnagggcacacaanggnacangngcccanaagcagcngcngnagggnncgnacgncggnngnngnacngnnganacacaaacgaaccgnggngccacaagngnaacaacaagnnacaangnagnaannagcngnggccggnngngcnngnccancnggcccgnccaagccnannncanccncgncngagcngncacanaanngcncanagcagaanaggncagnnggnncaggangnaaancnaaaanananncncnnagcgnngggnngnnnccncncanggcgnngnnacaggnnacacnngngnnngncnacgncggggncnccaacacacngcacagcgcccngnccaacgacccgaaanannangaaaccnnnngnnnaaanccacangccnnnnnnnnncnngnggacacaanggncnnngacaaanaanacancnaannaanannncannnaaacacnnnnnnagngnnngnncnaangngncnccananagcgaanaannanaangncnanacncacnnannnnaganagcaancgnaagcacacnnnacanacngcaaanggannnccancncnanacacnanncnnaaancngcaaanacaaagncananaccncagancgcngcaaagncnnnnngcanncaacgcannncaanncgannncangcacagangncnccaacgccngacacaaancangcaangnccgnggnnncnccncngcgnccnggaacanagnccngcagnagccnaccaaaaaangncngcnnnananangcaccggnnncggncagaccgnnnncggnnacacccnagnnnnnacaagannnggcannanagnnnagnannananaaaangnngaaacangaacaangngacccaaaacggnnagnccacaccnggcaanaaangnnagngagncacnnnnacaagacanagnnnggcanaacaaacnanngngcaagccaaaacngcacnnaagcanngaaagnaagnnaaaanangngccnanaagcangnnnaaacnangagnanaannaaacannnngcaacngcacngcangnananangagncacanangcaagnanaggcaaaagcagngcaggaagggaaaggannaacngnanngnnnaaanngnagnnnaaaaaaaacacgnnngngccagcaaccgaaancggnnacangcacaaaanggaggnaaagnaaaanggaggcagnacngnnaaaaacnanaaaanacanancanacaaanacnannacanaggnangcanaanaggcagggcagggnagggcaannnagggacagcaccnnacncanaganacacccaaacaanacaaanagnnnacaanacacacaanagnnnannacanananacagaaacaggaaacngacaaggacanagaacangnacacaaacangacacanaacacanacaacananacacaaacanaaacaaacagacaacacanacanaaaacaaacaaacangnanaanaaaanagngnaagnaccacaacaannannnnnnaaccnnnnngcgnnnggngganggngcacgggnagnaggggccgaacgnnnnagncngggcnnngcnnnaaggccnganngnaanaaaaacnnncgncccaaaggaaacngancnagancccccncgacncnagaggancngcagaaaacnnnnccnnnaagnnaaccncccaaaaagnanannnannnaanggancnnccnnnncnnnagggggngcngnnnnnnggcaagnaanagccngggaggnaacaaancnanangngnccngnaaacnggcagacggaggaggngnnaaaccaaanngccagnccnccaaaanannggaanccanagnangnananangncannancncngcagnnagngnaannnngcaaagcngaaaaacaaacngnaagncananncnncaacangacgnacanannccnnaaaannancannnnnanangnaccnnccnnagnnacnncagngcanaangncanannagngcnacgagnggnancaaccacggnaacaaanaacnganngccccagcaaangccanngnnangaccnngngcacgcngnagccaanaaggcnnannaaanaanngnganncngaggnaacnanagagccacnaggagnnggaaaaaangcacnacnnngganaacngcagnannaccggacccnnnaananaaaggncanccgggacagccncgccaagnnnnccagcccnannaaaaaagngncnaacaaacancngcncacgncnaagaaaaaagaacaaacnanccccanaaggnncacnggccannnnnaaanaancngganannngcangnacngnnacaaanancaanaggcacancacnnnnannagccngcaangnaccaaagnccangcanccaaacccngnancnaccangncaccanccncaanaanagaannaaaaagnnccaanggaggacaancagnagcagcngcannanngnnacaggcaacaccnnnaccccaangcncaccagngggaggnnnacagccaannaaacanaanngngnnngnnnanaanccanaganaagcanncccngnnancagacccnggcngngcggganancngnnacnggnnncagngncancaaannnannnaaanaaggangaccacnnacgccaacacccaanggcngnccccnaccnannncaaggccnacacangcccagaccaaacgnngngnancagggnnanaaaaagangnancaggaaaaccaaannnanngggancaggnaaacgcacccnaaagacccnanacngnaagccnganaccnngggaacnaanacnnnnnnanngnnanngggacnnnnganggaaaaanangganngccaacagccaaaagncnggaacngccagcanaanaanaaangcnngngcgngacacananncancagngcnnacaaccnnagacacaggcacaggaggcaggnacacagnggccncacnaggccgccacacggacanc

SEQ ID NO: 102 - DNA, 5863 bp, Artificial Sequence
  Human papillomavirus type 66 double truncated probe
  misc_feature (1)..(5863): n is u or t
cngnaaaaaaanagggaacacgnnnacggcgccnacgnnnaaaaaaananacaggccanagngcaaangnaccncccngnanananacancangngnaacancanaaggagacngaggnacaaagggccaagnacnggggccngnaggnaaaacnanancaggaccagaanaaaanggngnnncccaaacannncccaaaggggcagnaacannagnngngnnacnagcaaagganaangnagaaggnnnaanaggnaanngngcagaaggngnagcaccagacngacgaaangaaangggngccncancancaanannngcanaaanancananaggccancaaangganngncngnagacaanaanggcngcannncaannncancagccngngcaanaggacnnanancanaanaanaangcacacgagcaccnannngngnaccccnacgngnnngcanggnagccnnnnngccnagccnacnaaaacgcacaccngnncnacgngnagnaaangcaggccnangcaangcaacnananccanaaaancaggancaggagccacacccgagggagaaaaggncaacgnngngncagcaccnncaaaaacaggannancagcagnnannaangnngnggggnngnccaaaaangcngggncagngacccnaaccngcngaaaagcccnacnanacaancngggagcagcaaggcgncnaaaaccnggaanaggggnacnacnaanaggnncgnngccagnaccgngnanagcaaangnnngcanaggnannnccncanagcnacgnannccagangnaggagngcnaancaaaanannaccaganaccncnccagnnngnggagccncaannacnggaggancaanananagngggnnngnnanagnagnacnacnnacangnacagnacnagangngggngnaananccaacacagcaggngnggnngnagaagaggangngaccncaaagcccccngacccagnaaaanngggaacaccagccccngagnnaanaacacnaganncnncnaccagngnaacaanagaagganccgnaggcccaacngacnccaccacaanaggnggncgngcaggagngacancaacnanagnagaaggccnagagccnaagggaacanagcccgcccgaccacccgacccagacccagnaccaangccaagncccccaaaanangnaaanaaacnnccccanngnaaaanncnancagcccangnnnnnngcncnaccnnannaanaacanccncaggacangnaccaggnaannngcangnnnnananaanngngnggcagangcgcgnnngcgncgngnggcacggngggcaaccanagnagcaaaaacgnaanacngnnacaaanggnnnannaaccacaaagcangaaaanananacacagngnaggnananaaaaaaanagnaaaaacagnanaaangnancaaaaaangangnagccacaacaaaccaaaanaaagnaannagnanaagacaannggnaaacaaagangcaganagcaaaagcgggacaaaanggcacacacacagacaaacacaaaagcaaagcgcaaacacacaaannacacaaanancaanggnngcaanananagcgannacacgnnaccgnnnccagngnnacaanaacacanacnanaccaaanacaannaangggngcaanananangcgnagcagcaangnanggcaannacacnncanangnanccgngnnacaanaacacanangnananacaanananacaacacnnnanggacaacncannngncccaaaanaaccngnacacnaggnggnannnnnacaacannnaaaaaggngncccgnngcgnnncancnnnananaananngnaanaanacnacngncnnnannancngnacnngnccaanganangnngnngnnacancngnaaanaangnnnnanannnnngaaancngnancnacaacacnnnaancnannggcnncaccnnnnaaangaanngcaggngnagncnnancaccacagnggnngngngngnnganacgngcacnncnacngnnggcgnngnnacngangncngngncngnngngacacggngngcgnaggacncncnggaggagncaggnncnganncacnngcncngggncgnnnnccnggncngnggganaccgcggcgncnngggcgcccacagaggnggaggcggnggnggnggnccngnggnngnngnanncgnnaacagncncaacagggggnacgnngnancnacaggnacnagacacagagncaggacaanaaanacncncggnnnccanangnacnncccanangnnngnacacccanannnnnnggccnccngnncaaagncngngnaanangnnnngnggccancangcananaananangccncngnaanccaccccngangacacnnnacaccacccacacncnccannanaanananaaannnccacaccacanannccanacaannannnnngnnaccancaaaccacacnncnanangnngnccnncaanagnnccngcaannggngngnnggngnnnccanannngnancnananccanannnaccaccgagngcncacnacagnnacngnnnngcgagccnccannnngngagcncccgcacccannncccnnnncgnanncnaccngnngngangnnnccaangnnnccaangnanngccgnacccgcngncnncnganaanannagccnncgnnnnacnnccncccggnacacagnnngcngannacnaanancacnnaagggacnaccnananacnnncgnnnnagnnnnngcaacgncngngcancngcangngcngnnngnacnngcaanaanngnngagcngncncccngncnnccngngnanngnnnanaagngnanngncnanaaanccancnaaancngnancngnnncanncnccnccncgcnnncancancngananngnancccccgnnnnncnnncnacaanngcnncnaccngaaaccanccacaacancccgnccccnccccannngnaccnncaggngangccanngcagnnannnagnngacgcgcagagngggcacgnnacngnnaacgcacccanaagcagcngnngnaccacacgnagcnccncnnnggnacncngaangnccaacngcaccacaagcncacacnnacaacaaggnacgngaannaggnaacacnnangnngnncagcnngncnagcnngcngnggccgcnccagcaaanggncnannncanccncanccncanccncngagcngnccaanngcncanngcanngnaggncaannncagnnngcggngcaagnncnaananaancncnngcaacgnnggngcnnnaccangcanggnnanacngnaganncngnggcnngncnacncgnangncnccaacacngcaaacangacccggnccangcanangcnananaangaaancgncnnnnangnncacagngcaanngnnnnnccnccggngnnaacggacanngacancggnagcaccnnannganaaancaganaacngnnnnnnagnnanaccnncnaangnngccccanacacngaanannnanagnaccnanannnncnaaccnnacnanaaaacaanaaacanacccnacanacngcananggccaanngnnncnananacnaannnnaacncaanacangcaaaccnananaacncnaaacnngnaagnnccnnnnngcagnanacacanganaancnaagancaagnaaaggnannngnaanaccncgcncaganggngcaggcnncgnggacgnnccngngnanngcngaananggaanccangganancnacaggcacaacaggcngccnnnnanangnaccgnnnncggnccnaaacccannncggnnacncccaananaanaaagnanganngaaacnnncaacaannaaaagaaaccngncnnagcacgaccgnaaacggnnnngaaaaangagnaagnananggnnacanannngcaagacaganacnnggcnnanacaanaagggcnacacgccaacaaaanananngcaaacaccngcanaaaaacanangcccaacagcgccaaagnangcaganaaaagcanagnnggcacagaaanacnggngagnaanacagggnaaggcagngnacanaccngaancanacaacaggaaacggcaanangccaaaggannaacngnnnngcngaaaagncgnnnngggnnnaaanaaggacaaaaggcnaggcaaccgaanncggnngcangcanaaaanggcgnacagcacnaaaanggagnnnggnangnnacnanagngcanacaaacaaccnannnaananaacagnaaacagnaaggaacaccaccnaaccngacacacacngcccaagganacnaccgcaccnnagnnnangcaaccacgcgnaaaagnaaccangcangnnnannacanacacacaaaacannacacanacanacagncanacanacacanagcacanacacaannanaaaanacanaaacanacacaaaaacanacagnacaagcacaaccanacaanacanacaacagacaacacacaacnancgncnnnnacgnnnagcnggnaaagaagaggaagaggnaggagccgcccgcnnnnnagaggcagangcacnagccnngggncnagggccnagnngcannaaaaannnncnacccaaaggaaacngancnaggncngcagaaaagcngnccngnaaannaaccncccaaaacnnanannnagccagggganccngcnnnncngcagggggcngnncccnnngacangnaanagcngngcnnnnaanangccnanannnanccncnaagcnagnngcaacnggnggggacaanccaangnnccaancgncnaanaaagnannanncanannangcaaanangccanaacnncngcagnnaaggnnannnnacaaagnngaaacacaaacngnagnncanannccnccacanggcgaaggnannganngannncacgngcancanannnagnnaangngcnnnnagcngcannaanagncangnnggnacnncnggnagnanccacaacagnaacaaanaccnggcaccncagccnnngannccngnaanngcnnaaagnccanngcaccaaacccggngnccaccangncaccgnccncnannggggnannaacnaangccaaaggnggacaanccccngnanngacnggngnagacnnacacaccgcgcccnnagnccaangnncaccnaangcnggcgcacancccacaanacanaacngggnnngnnnacaancaacaganananngncccggnnancnncngcaacannannacnngcnaaannagagacnncagngncanccagccnannaaanaanggangaccacnnaacccagcaccnaaaggnngaccncggccnaccnccaaaccnacacaggcccanaccaaacgnnccnggncaggannanagaaaganggancaggaaggccaaacnnannaggancaggcaaccgnacccnaaacacncnanacnganangcacnaacnnnagggangnnngnnnnggnaccagannnagaaacagagnaanaagganggccaacagcaagcaaccnagagcnaccngcanganaaaananacnggnacgnnnnacanangnanccgnngccacaaccnnngaaacaggngnnggaggnaggnacaccnnanngncacnagaacgccanagagccanc

SEQ ID NO: 103 - DNA, 5444 bp, Artificial Sequence
  Human papillomavirus type 68XX double truncated probe
  misc_feature (1)..(5444): n is u or t
cngnaaaaaaanaaggaaggngnnnacgnnnnnnnaanaaaaagaanaacaanggnaanaaanaanaannggaaccanananagnnanggcaaaggnngnancaannggagnagagggngnnaaaggcaacngnggggnngnaganggnaanacaacancaggaccagnannnacaggcgngnnccaagcagnaccaagaggaanggnagnannagnanangnagnggangcagcagaagccaangaaggaacnganangngggaacgagnagnaaangnagcannangaaangcagnancnaanacngnagnanngncagnancaggngcanananancananaagnnanccanagggnccgccngcncaggggcaaccaanggnngnagnncaangcngncagcaggggnaangnnacnaanancanganaanagngcaccngngccccaannngngnaccncggcgngnaaacanggncgccnnnnngccnacncngcnaaaacgnacngnnccncnncgggangnnaaggcaggccnangnaaacgaacaangnccagaaaanccggancaggagcnangncagcaggnncanangnaagagnagnancaacaggcncaaaagcaggannancaaangnnacaaangangaagggngcgnnacaaaancaaaannacnaacacgaaccngnngangngcccnacnananaaacgnggcccngccacacgacnaaccccaggnanaggagnacnacnaanaggnncngnaccagngccangngnngcaaanaccngcanaggnannnccncananccangngnnccngangnaggggnacnnacaaacacannaccagacaccncaccngnnngnggcacnncnannanagncgggncngnaaangcagggnnagnaaaacnagnacngcnnaccngcacagacccggacgaaggggnaangncnaaaacngccggngnagnggnagacgaagangnaannncaaacccagaggngccngnaaangnnggnacnggngncccagangnaanaacacnggaanccnccaccaanngcacaanggagggnnccgnaggacccacaggnncaanaaccacaggnggacgngcaggcgacacanccacaacagnannaggnnnnccaccnaaaggaangnacccagcacgaccnccggngccagagccagnaccnanacccaggccacccaaaaananaccnaaacnngnccanngnaanannnngncngcaagngnagnaccnncaaccnnannnanaacancagaaggacangncccnganngnnnacangnnnnananaagncagnngcagangcacgcnngcgccnggcagcacggngngaaaccanannnannnanacaaanaaacaacaanacaaangcacacnanaacagnnacngnanagnannaagagnaagacngngnaanaaccacanaggcagnanaaaaaaaagnaggnanacagcaaacaccncaaanggngnagnncnaacnaananaaacacaaacacaaananccacacanacacacacacangcacagacngcaaaagcgggacagngcaacanananacangcanacacaaaaccacaccaaaaanaccaanacaagcanangnanacaananacananagngnacagngngggncaanacacacnnanaangncananaccccaangacacagnnacacnaganggnagnnnaacagnnnccaaaaacnngncacgnngngcnncngaaacanangnnacagncaananaccngnannggnnganccccnaccccnnanccaangccangnacanganananngncanacaaagcgnnangnnnnngcaaccnanaccnaagacannnnaanccannnnngncaccnnnnaaangcacnanaggngnagngncaccacaacaaaggcnccgncnnnngnnnnggccngcacnncnacngaggagngggaggncgacaccgnccacggacacgnngncgggcncagagggcncagngannccgcacngncnggganacnnccgagacgacgncgnacgnaccaggncannaaangacaanccananacnnnnnnaaanncngnnaacanngcagccnnnnnanngnnacanngnaanaanacnnnaagnngggnagnaggngannnagganccnggnnnncacnancnanagcacngnccacacnacnacagnccncccgnanacngncgccannnnccccnncannnnccccanccnccccannnanannaggngcnacagnnaccnccgagnnagnnnccacnnccananngccanagccgcngnccggcacngnanacgccggnngncnngccngngnacngcnnacannnagnganaannccngnaanggcgacnnngcnaaaggacngcnnncnanacngncngnanacnnncgnnnnagggcacgcacccnnngngcancccnnngggccncnngcananncaaaagnaccngngcngncncacgcncngccngnanacaaanangngnagaancancaanaaaancnaccangncngaaccngnancngnngcgnnnncgnccncanccncngagacngngncaccngnnngnnnancnacnanngcnncnacaaaaaaccanccgnnacaccccgncccgnccccancggnaccnncacaannggccanngcagannacngggnnncagnngcacaccacggacacacaaaannnagngagnccanaaacagcngnngnagngnccgcaggnngncccgcgacgcnncnacnacnagnngcagngccnngnnacacnnacaacacagacacngaanncgaanncngngacgcngnngnncgncccgncnggcnagnagnagangnnggnggngannaacngcanggncgggnncancnannncancgncngaancnccnaanngcncgngacanacaaggncaaccggcngnannncanngnanggacanagcncnaacacaannnccngcacggngggcnnnggnccangcanagnnacnnaaacnngngnnncnngacgnangcgncngcggnccncncgcnnacnggnccagcagngccgacacngnccngnaaagnnnccngcnannnnangnaancnncgnnnngnngnnaggngccnnagnnnnncngcnggacacaanggnnncaggcaacncangcaccnnancaanaaannananaacnnngnannagnnanggnnncnaangnagnngcanacaccgannccgagnaanancgnagnncccgnannnnagcanaaaannnaanacangannggcangcagcaaanggnaccccgncncnanacacnacacanaggncacnaaaggcaaanncananaccncngnccgnngnagnngccnncngcaanagacacagncnanngnaacgncangcaangnagngnccaangnccngcacaggncnggcaannngnanggccgnnccncagggnngngaaanagcgccannagnanagagaacngcngngnncagcnnnananacaccgnnnncggncgngaccgnnnncggncccacccnnnnnnnananagaanaanngnaaaangnnanaagnaaaagnannggnangngngcccaaccnnnnncggnngcacaaannnanggangnagnannagncacngnanaacnnacacnaccagacaganncnngaangcaaaagnagnnanacnggccaacnangcnannaggcaagcaaaaacagnnaaaacnnnangccnaaaagcagnnnnannacaagggaggaganacgnnggnngccaaacnanngnngcagngcaccnggacaggangangacnaacnaaggngcgccagnacgacngnnacnggngccaacnangngggnaacncaaggnaaaacangnnnnngcngaaacacanaggnnnnaanacnancnaaaagcaaanagnaccaacgaccgaaagcggncgcacacaacccggccanacaaaanggccacacggnanagnnngcaaccanaaanananngcananaangnaacacaccnnagggnagggcnacaaannangnangaaangnngcagnccnannanangnaaaacaaggacanangnnagncacagggngcaaccacaaaggacacggacanacanacnnnannaacaaaaacagannanacacacanacnngcaaacanacacananacacanacacanacangcacanacacaacanaccaacaccaacangacacananacaaccacacagacaaacaacanacaaaacaagacananaacaannannnngacacacgnnnacgnnngngnnnagaggnagangnggnagcngcagnggcagngcgnnnacgagggccnanggngggccgncngcgaacaccngccngnaacagaaannngcgnccnaangggaannggnccagnncagaacnaaacnnnnccnnnaaanccacannccaaaagnnaagaccancanagggancnnnnnnaacaggngcaggggcgnccnnnngacangnaanngcngcnganngnaggnagcggnangnancnacaagacnagcaganggnggaggggcaacaccaaaannccaancanccaaaanagcagganncanagnangnananangacannacancagngganaangnnanagnacacaacngaaananaaacngcaaancanannccncaacangccnaacanannccnnaaannnannagaancanacacagcnggnacagnagagncngnagnagnggacaangnaaaannagnacngcgcgnngnanccacaacggnaagaaanaanngannangccaacaaanaccanngnngngncccngngccnngngcagccaanagggcnngnnaaanaacngggagncagaggacaccanagacccgcnaggcgagggggcanacacanaacnacnaggagnnncacgaangncagngcccnnaananacangncagngggaanagngnccccnaccangccnccccnannccaaaaangannncaacaccaacacaggcccanaccangcgcngngnancnggannananaangnagacncaggaacacnaaannnannaggancaggnaaggnaacccnaaacacncngnannganangcagacaccnnaggaangcccngcnngcggcccccagacanaggaaccnnaaaanangganggccnacagnnaanaaccnagangnaccagcanagnaanacangccagngcgngncacanaancancngnanngacaaccnncgccacngaggggggaggcaaanacaccangnngncgcnagcncgccacaangccan

SEQ ID NO: 104 - DNA, 7911 bp, Human papillomavirus type 33
ctgtaaaaaaaatatggaaaacgtttacgcctgcgacgtaaaataaaataactaggatgtaaaacaaagtcagcaccgtctacaacaatggtgtcaaaaggaaaaaaaggcgaaataggaacaaatgggctagatgtgggaaataaaggggaaggtatatcagggccagacataacaggagtatcaaatcctgtatttaaaggtatagacacattgctggtacgtgttgttgcaaacgtactgtatgagtgttgcattggggtgtgtacattatccacatcgtcagcataaacatcatacaaaccatcattaatactataagacgatgtagaagtatcatgtaaaggctgtaattcatattgttcatttggcacggtgtggtctaaaggcacaataggacttaaatcctgataataatgtattctagctccaatttgtttaccactgcgagttttaagtgtggctttttgacctactctactaaaacgcacagtatgtctacgagatgtaatagcaggcctatgtaatgcaataatatctagaaagtcaggatcaggagcaggtgatatatcactatgttgaaattgtaatgtgtcttcagggtcaaagctttcaaatgcaggattatcatatgttataagtttatgaggcgatgttaaaaaagcagggtcaacaaccttaacctgttgggtattgcgactatataaaccaaggcgtgccacagggcgagaccctggaatgggcgtgcttgatgttacattactactgtctgtggaaacaacaaaggtatccattggtatgttttcataactttgtgtgctaacagtaggggaagaaaatataaaatgtccagaggcttctgcaggcgctggagggtgtagtacagatggttcagtaaatgtgggatttaaatgtgtagaaatagtttgaatagatgactccccaacagatgaaacattaataattgcaggtgtagtatctgcagatgtagtaacatcaaaacctgatggtgtaggaatagatggggctggtgcacctgcctctataaaacttgtttcttctattaatgacactatagacgagtctaaaggtccaacagtgtctacagtaaccggaggacgtataggctgcaaggggattgcagctgtaggtgggtcagtaccaataggtacatagccagtccttccacctgaaccagagcctgtgccaatacctaaaccaccaaaaaaaacccctaaactgccatatttaagaatttgatctgctatggtacttccttccactttaggaataacatcgggtgggcaggtgcctgtggccttgcatgtttggtatagttgtgttgcagatgcacgcttgcgccttgtagatcgtttgtgtctcataataatacactgctaaaatataaaggtatttattagtaatacaaaaaaaaaaaaactaaaataacaacaacaatgttaaaacaccaccatgtgcacatatatacaaacaatatatacatgtatatacattactcttgttgtgtcatatgctgtgcatgaaaattaatacacatcattggtaaatataaaaacaacaaatagcaaaaaaaaatttttaaaggagatcccacaaacacccaaagcagcaataccaacacctgcaaccaagcataggtagaaatggaaagtattaaaggacgtaataataaggataagcataaaaacaatataaaacataatacaaaaacaaatatcatggttatatacaattagcagcacatattggcttgtgatgtacacttataatgtcataaatccagtacttatttgcacagtaggtggtatttttacggtacctaaaaacatttgttgttgctgttcagttacaaatgttacagttacaattccatttttactatttttgttgtcactggtccaatgccaggtggatgacatagaactatacaactctttataaggttttaatctgtatcttaaacattttaaactatttgattcaccttttaaatgcactataggtgcaacgttaggactacacacagtccgctgcttgtttgtgcagttagttgcagtacgtgctgttctattgtccaaggcggggtctgcacagaacagctttgtaaggggctgggcggtgtctgtggtgtctgcaggtcgtcgtcgtttggccgctgcttgtggtggtcggttatcgttgtctgtctgtatgtcagcagtttcagtagtggatatttggttgctagatatagacgtaggacaaacaattacctgaccacccacatgtacttcccacatttgtgttttagaatactttgcagcatcctctttaaaatatttaaaatataccttttcacagttatgtatataatacatacctatataatctactttccctgtaaccatagtacatgtatcttcctctataatatatatttcaccccagtttgtataatccattgtattttttttgtcattgtcatattgcacagttactgtttctccttgttttttaaaacattttggtggttcacaaagccacacctctaagcttgtttgttgcaatgtccattggcttgtactatactgtgatttacttaatgtctctaatgccatttgtagttcaattacttgaaatgctttggtctttgatgctaacaaagaaggcaccacctggtggcataaatgtgaaaatcccatttgtttggctgtatacaataaagcacactccatgcgtatcagtttccaatgttcaatttgtgatggtaaatcagttttatcagcttcgtaaagagctagcattttctcctgcactgcatttaaacgtgctgatatttcctccatggttttccttgtcctcttcctctattaaatctaatttgcaccacgtccttgagaaaaaggatttccaattttcatcatttattgcatacactgggttaccattttcatcaaatgggaatggatttttaaattcaaatactgttaatctactatgtaaatatggccatctagagtctgtgcctgcatttgtatttgaggtaagaagcagtggtggacattttaattgcactaatgccctatgtttcacatctattgaaatttcatttccatctaacgcatttctcatgtaatcatctatatatgtccaacttattggcgttacatcatctatcattcctatttttgcatctgataatggctgcaaccaaaagtgacttttagaatttacacatgatataacacacccttttaaaaactgtattaaactcattccaaaatatgactttcctgtatttgctggtccacaaattagcatacagcttttttttggtataccttttaaaaactttttaaatgcacctaaaaatgctgtaaattcaatgttttgatatcttaacaactgtactattggtctccaatttcctccatcatttgttttttcacatctactttgtatccattgtcctattgacattttacgtttttctgcttttttataatgtctacacattattccacagtcctttactatttttgcttgtgagttactttttaaaaatgcagcagcattactatttgaatctgcaagttgtgcataataatatgcaatgtcactatcgtccgttaactcgttatcatatgcccactgtaccatttcacttaaatcaaatatattatcattaaagctatgttgtaaaacagttagtctatctatccattcaggtgttgtaccttgtacatcactaatgtttgacattgctgttctaaaccaatacaatgcacatgtttggctccgtaattttggtggctctataaccatacatgtttcaggtattgataataaattactcattagttttgctactgttaacctgtttttgctacacctaaatctaattaacaataatattattattcctctatcgcaagttaaacattgtaaatgagtatacaaactatgctgtttaattaatacttttaaactttctgctactgatggactaattccatatcctgttatacaccaatctgtacagcttgttttatcacttttaaatggtcttactaattccataaaacttattccataggcctctttaaatttatataatatatttgcttttgtattactactatgtagaacattactaatttcctgcaacgtaacattttcacagctatctacatttgtctcacagcttacttctgaatcatcccccaccccactagattctaagtcatttaagtttgtgtcgccattttgactttctacctgttgtaccatctgctgagtttccacttcagtattgccatatccgctgtcttctagctcatctatttttcgttttctgtatgtgcattctttatttttattaatagacgttctacacgggtttgcagcacgatcaacaacgtcctccgcagcactttgtgaacatgcggcaaactttcgttttagtgcacacacagcatttaaatcatcctccccttcctgtatattaaacaatgcccgggctgcctctgtgtctgcctgtatactattttccatagaatcatctataaactctagtaaatccgtgccactgtcatctgctgtttcatcctcatcttctgaaatattatctcctgttcttctctctatgactgcttctacctcaaaccaaccagtacaccccatcccagccccatttgtaccttcaggatcggccattgtagatgatgtttattgttgtgcacaggtagggcacacaatattcactgtgcccataagtagttgctgtatggttcgtaggtcacttgctgtactgttgacacataaacgaactgtggtgttacaagtgtgacaacaggttacaatgtagtaatcagctgtggctggttgtgcttgtccatctggccggtccaagccttcatcctcatctgagctgtcacttaattgctcatagcagtataggtcagttggttcaggatataaatctaaaacatattcctttaacgttggcttgtgtcctctcatggcgtttttacacgtcacagtgcagtttctctacgtcgggacctccaacacgccgcacagcgccctgcccaacgacccgaaatattatgaaatcgtttgtttaaatccacatgtcgttttttttcttgaggacacaaaggtctttgacatataatacacctaattaatatttcatttaaaggttttttaactgtttgttctaatgtatttccatatacagaataattataatgtctatattcactaattttagataagaaccgcaaacacagtttacatattccaaatggatttccctctctatatacaactgttaaatctgcaaatgcaaaatcatatacctcagatcgttgcaaaggttttttgcattccacgcactgtagttcaatgttgtgtatagttgtctccaatgcttggcacaaatcatgcaatgttcgtggtttttcctcagtgtcttgaaacatagtcgtgcagtaccttactgcaaaatggttgctttatatatgcaccgttttcggttgaaccgctttcggttacaccctacttttttaaaacttggcattatagtttactattatataaaagattataaatgaccaatatgacctaaaacggttagtccacacctggtaataaacaggtagtgactcacttttacaaggcatagtttggcatacaaagcaattgtgtaagccaaaactgcacttaaggtttgaaagtaaagtaaaaatatgtgcctaaaagcatgtgtaaactattagtacaattaagtattttgcaattgcactgcatgtatatatgagtcaatgcagcaagtacagacaaacacagtgcaggaaagaaaaggattaactgttctgccaatgtcatagggtatgtatgccaatgcagcaagtacagacaaacacagtgcaggaaagaaaaggattaactgttctgccaatgtcatagggtatgtatgccaagtaaccgaaaacggttaggcatacaaaatggaggaaattgtacaatatggacactagtatgtcaaaaggtaaagcaatactaaacatgtaggtactacaaatatagggaaataaaggtaggtacattgcaatgcagggtagggcaagcaatacaactccttactcatataggtacacccatatacataacatacatacaaatagtttaacaaatacacacaatgttttattaacatatacacaaacaggaaactgacaagtacatagaacatgcacacaaacaagtacacataaaacaaacacagtaacatacaacataacatacattgtaacacatacacaaaaaacaaacaacaacacaacacaacaacacaaagtacatagacagaacaaaacaacaacataacacaattacacaaagtgttattttttaacctttttgcgttttgcagacgatgtgcgggtggatgtgggggctgcacgtttaagtttaggttttgctttaagacctgcctgtaataaaaacttgcgtcccaaaggaaactgatctaaatctgctgaaaatttttcctttaaatccacttcccaaaatgtatatttacctaaggggtcttccttttcctttggaggtactgttttttgacacgtaatagcctgagaggtaacaaacctataggtatcctgtaaactagcagatggaggaggtgttaaaccaaattgccaatcttctaaaatatctggattcatagcatgaatatatgtcataacttctgcagttaaggtaactttgcatagttgaaaaacaaactgtagatcatattcttcaacatgtcttatatattctttaaaattttcatttttatatgtactgtcactagttacttgtgtgcataaagtcatattagtactgcgagtggtatctaccacagtaacaaatacctgattgccccaacaaataccattattatgaccttgtgcacgttgtagccaatatggcttattaaataactgagattcggaagtaaccattgatccactaggagtgggaaaaaaagcactgctttgaatagaggcagtagttcctgaacctttaatgtacaggtcatcgggaacagcctctcctaatgtaccagccctattaaaaaagtgtcttacaaacatttgttcacgtcgaagaaagaaaaataaactatcaccataaggctcactagtcatttttaaataatctggatatttgcatgtactgccacaaatatcaataggaacatcacttttattagcctgcgatgttttaaaatccatgcaaccaaatcctgtgtccaccatatcaccatcctcaataatagtatttataagttctaaaggtggacaatcattggcaggtgctgcattagtacaagcaacacctttaccccaatgttcccctgttggaggcttacatccaagtaaacataactgtgtttgtttataatccatggataaacattccctattatcagcacccggttgtccaggatacttgttaccggtttcagtgtcatcaaatttgtttaataaaggatgaccacttatgccaacgcctaatggctgccctctacctatttcaaggcctacacatgcccatactaatcgttgtgtatcagggttataaaaggaggtgtcaggaaatccaaatttattaggatctggtaaacggaccctaaaaaccctatattgcaagcctgatactttgggtaccaataattttttagcgttagtaggatttttaatagaaaaatatggatggccaacagcaagaagtctggaactaccagcataataataaatgcttgtgcgagacacatattcatcagtgctgacaactttagatacaggtacaggaggcaggtacactgtggcctcactagaccgccacacggacatc

SEQ ID NO: 105 - DNA, 7834 bp, Human papillomavirus type 39
ctgaaaaaaaatagggaatacgtttccgtttttttaggaaaaaatacaataatggcaacaaataataattggaaccctgaatggttattgcatatgttgtgtctattggtccagaaggcaccaatggcaactgtggagtagtacttggtaaagcaatatcaggaccagtatttacaggcatattccatgaggtactaaaaggaatagttgtattggcatatttagtagatgctgaagaagccacagaaggtagtgagcctgtgttatatgtagtgcccgaatcccttgtattattaaatgcagtatctaaatatgtgttattgtccacatcagcatatatatcaaataatgcatctgaagcatcagagggctcagcgtgaactaggggctgtaattcaatgctttcagcaggagcaatactactaatgtcatggtaataatgtacttgcgctccaatttgtgtgccacgccgggtaaccatggtagcctttttgccaagcctactaaaccttactgttcctttacgcgaggttaaggcaggcctatgtaaacgaacaatgtccagaaaatccggatctggagctatgtcagcagcttcatatgttaatgtagtatcaacaggctcaaaagcaggattatcaaatgttacaaatgatgaagggtgagttacaaaatcaaaattactaacacgaacctgctgatgtgctctactatataaacgtggtcctgccacacgactgattccaggtgtaggtgtgctgctaataggttcggtacctgtgccatgtgtggcaaacacttccataggtatttcctcatagccatgtgtacctgatgtaggggtactgacaaatatattacccgaggtttcacctgtttggggaacctcaattaaggaaggatccgtaaaggcagggttagtataactagtagaggttatttgtacagacccagaggagggtgtaatattcaataccgcaggcgtagtagtagaagaagaagtaatttcaaatccagaggtgcctgtaaatgttggtactggtgttccagaggttataacacttgagtcctccaccaattgcacaatagatggctcagaaggaccaacaggttcaatagctacaggtggacgtgcaggagacacatctacaacagtattaggcctaccccccaggggtatatatcctgtgcgtcccccagtaccagtacctgtgcctatgcctaacccacccaaaaatatacctaaaccagtccactgtaaaattttgtcagcaagtgtagtaccctcaactttatcaacaacgtctggtggacaggtacccgattgtttacaggttctatataggtcagttgcagatgcacgcttacgcctggcagcacggtgggaaaccatgtttattagtaacaaaaaaaaatataaaaagctatgtacagtagttatgcacaatgcacatacatatacagtactatatcatatccattgccagtctatgcaacaaccacatgggcaatacaaaaaatagtaaatatacaaaaaacacctccaatggtgtggtacgtataagaataaacacaaacacaattatccacacatacgcacacacatgcacagacggcaaaagcgggacattgcaacatatatatatacacacaccaaaccacaccaaaaataccaataatatcatctatgtagtatgtatacaatatacatacacaatacccatagtatactttacaatgtcatgtaacccaatgaaacatgtacactagaaggtattttaacagtgtccagaaatttttggcgttgtgactctgtggcatatgtaacagttaatatgccagcgtttttggttcccttaccccgtatccaatgccaggtacatgaaatattttcaaacaatgtgtcatatttttgtagtctatatcttaaacattttaaaccatttttgtcaccttttaaatgtattataggcgtagtgttaccacaactgaggtaccgtcttgtgttgtggcctgtactgttactgtggagtgggttgttaagatggtccagggacactccgtcgggctcagtgggctctgtgactgcacactgtcgaggtcgctttcgagacggcggcgggattgttttttgggtgcatggggttgttgcggtggaatgggtcgcggtggtgtttgataattcggtagtaagttcagtagtgggtaccgatccgtcactggtactgcacatagagtccggacaatgaattatgttgccattataatgcacttcccatttgccactagtcccatacctttccgcatcttgaataaacacttcatagtatacttttaggtgctcgttcatataatatataccccaatagtccacacacccttctgttttacaccatatgtctatattatttttataatatatagcaccccataatacatagttcatagcattacatttgtccccatcataccacacctccactgtagttccttgttttttaaaacattgttttggctgtgtatgccacagttcattactagtgtcttttaatgtccactcctctgtattgtattcagtttgtgcaacactttctagtgccatctgcagttcaatagcttgatatgctttacattttgaaatgtttatggttggcaccacctggtggtcaatagtatgcatgccacgttctcgtgctgcataaaatattgcattttccattcgcacacatttccaataattaatttgatcatatattgatttactgtcttgttcatagtattctagtattttgtcctgtaacacatttaaacgttgtgaaagtgttttcatcattgtctccttcatcctcgtcctgctgcaagtctaatctgcaccaagtcttttcaaaaaaacatttccagtttttatcattgattgtgtacactggattcctgttttggtcaaatggaaatgcattaggaaatttaaacactgttagcctactacgtaaatatggccacctatcgtcttccacaggattggtattggaggttattaataatggtggacatttcatttgtagtaaacttttatatttcctatctaaacttattgcatacccatctaatgcatttctcatataattatcgaaatatgaccagcaggtaccggttgcatcatctaacattgctagttttgcatctgcaagtggttctagccaaaagtggctggtggagtttacatatgaaataactgtgccctgtaaaaaatgcataaggctcatacaaaaatgtgactttcctgtattcgcaggcccatatataactatacagttttttttgggagtaccctttaaaaattcctttaatgcacataaaaaggatataaattctattccttgatatcttaagaattgtactatgggtctccagtccccgccttcatcacatttactacacctaaattttatccattgagacatggacatttgccttttttgtgctcgcttgtaatgtttacacattgttgcacaatcttttacatattttgcctggcagttactttttaaaaaggctgcagcattactgttacaatctgctaacattgcataattaaatgctatgtcactttcatcagtatattcattgtcaaatgcccattgtaccatgtccgataggtcaaatacactatcatctattccatgttgtataacagttaatcgttgtatccattctggcgtatcccctgttaccacactaatattggatatacctgtgcgataccaatatagtgctgctacagggctgcgcagtttaggaggctccagaagcatacaactttctggaacatgtaacaatgtacttaatccctttcctacagtaaccctattttttccacatgtatatcttattagcattaaaattagtactccttgttttgtgtctaagctttgtatatgtgtatataaggcatatttgttgattaatgttttaaatccttctgcaatagttggatgtactccaaatatggctgccacccagtctgtacatgttgttttatcacttttaaacgtacgtaccaggtcagtaaaggatagtccatatgtttctttaaattgtgttagcattgcagcctttttgttattggattgtaacaataatttaatttgtgcagttggagatttgggatcctggttttcactatctatagcactatccacactactacactcctcccgtacactgccgccatgttccccttcagcatccccatttgtattagttgctacagttacctcctccacttcagctgtttccacttccatattgccatatccgctgtctggcacggaatacaccgtttgtgttgcctgcgtactgcttacatttaatgaaatttcctgtagtgttcccctggtattcctgcctactttttttccatacggtctagtgtcgccactgctgtctgtatactttcgttttaaggcacgcactgcttgtgcatccctttgggcctcttgcatatgtaaaagtacctgtgctgtctcacgctctgcctgtacacaaatatctgtggaatcatcaataaagtctgccaggtctgaacctgtatctgttgcattttcatcctcatcctccgacactgtgtcgcctgtttgtttatctactattgcctgtactagaaaccatccgttacatcccgacccatccccgtctgtaccttcacgattggccatagcaggttactggtttgcagttgcacaccatggacacacaaatcctagtgagtccataaacagctgctgtagttgtcgcagagtatcccgtgaggcttctactaccagctgcagtgtgttgttacacttacaacacgaacactgcattgtgtgacgctgtggttcatcccgtctggctagtagttgatgttggtgattaactgcatggtcgggttcatctatttcatcctctgactctcctaattgctcgtgacatacaaggtcaaccggctgtatttcattgtaaggacataaatctaatacaatttcctgcaaggtgggctttggtccacgcatatctgatgttatacttgggtttctcttcgtgttagtctgcggtcctcccgttttgtggtccagcaccgtcgacactgtcctgtatagcttcctgctattttatgaaatcttcgtttgctatttaggtgtcttaatttttctgctggacacagcggtttcagacaacacatgcaccttattaataaattatataactttgtattagttatattttctaatgtagttgcatacaccgagtccgagtaatatcgtagctcccgtattttagcataaaattttatacatgattggcatgcagctagtggttccccgtccctatatactacatataaatcactaaatgcaaattcatatacctcggtttgctgtagtggtcgtctgcaatagacacaggctattgtaatgtcctgcaaggtggtgtccagcgttgtgcacaggtctggcaatttgtatggccgttctgcaggattgtgaaatcgcgccatcggtatggacagaaactgtgactgcgttttatatccaccgatttcggtcctgaccgttttcggttactccctttttttaaacaagatacttataaaatgttataagtaaaagtataggtatgtatgcccaacctatttcggttgcataaactattgtgtgctacattagtcacttgtataacttatactgtaagacacattcctgaatcaaaaagtagttatacaggccaactatttaattaagcaagtaaaaacagctaaaatatatgcctaaaagcagttttattacatagggtggagatatggatgttgccaaagtattgttgcagtgcacctggacaggatgatgagtaataaggcgcgccagtaaaactgttaccagtgccaactatgcagggtgaacctaaggtaaagacatgtttttgctgagaaaggtggtttccactagtttaaaaaaaatgctcaacccacgaccgacttcggtcgccacaaaatggcgaagtataaaatgtagaaacgcgtacaacaatgtaaaaattacatattaggtagtaaacacaccttagggtagggcatatagattatgtatgaaatgttgcagacctattatatgtaaaacaaatacactgttagtcacagggtgtgcaatcacacatgaaactgtcatacatactttattaacaaaaacatatacacacatacctacaaacatacacatatacactcaacacataaggaaacaaacaacatacacacacataacaaggcatacacatgcattatttagacacacgtttacgtttgtgtttagtagctgaggacgaggaagtggatgcagcaggccgctttcggggacctatggtagggcgcctgcggaccctggcctgcaacaaaaatttacgtcccaaagggaattgatcaagttccaaactaaacttttcccttaagtcaacattccaaaactttagaccgtcatatggatctttcttttcaggtgctggagcatccttttgacatgtaatggctgcagactgtaggtatctgtaagtgtctaccaaactggcagatggtggaggagctacagcaaaattccaattgtccaatatagaggaattcatagtgtgaatataagacataacatcagttgttaatgtgacagtacacagttgaaatataaattgtaaatcatactcctccacgtgcctggtatattccttaaacttagaaggatcatatgtagaaggtatggaagactctatagaggtagataatgtaaagttggtactacgggtagtgtccacaacagtaagaaataattgattatgccaacatataccattgttgtggccctgggccttatgtagccaataaggcttattaaataactgggaatcagaggttaccatggaaccgctgggagaggggcagtatacagaactaccggggtttgcacgtatatctgtgcccttaatatacaattgggcaggaatggcgtcacccaccataccaccacgattccaaaaatgtcttgcaaacagttgttccctacgtaaacagaagaacatactgtccccatacacatctgcagacatttgcaaataatcaggatatttacaaatggattgacaaatatctaaaggcacctcacttttggtttcctgcaatgcaccaaagtccatagctccatagccagtatcaatcatatcaccatcctcaataggggtgtttactagttccaaaggaggacagtcccccgtagatacattattgggcttgcatgcctttcccttaccccagtgctccccaatggcgggaacacagcctataatgcacaactgtgtctgtttataatccacagacacattatccctactgtccttattggtggttgatgaaaatggtgagttttcagtatcatcctgtctattatataatgggtgtccactaataccaacacccaatggctggcccctgcccacctccacccctacacaagcccatactaaacgttgtgtttctggattatataaggatgcatctggaatactgaatttattaggatcgggcaatgtcacgcgaaataccctatattgatatgcagacacctttggaatgtcctgcttgcgaccaccattcatacccactttaaaatatggatgtcctactgttaataatctagagctgccagcataataatatatgcctgtgcgtgtaacataatcatcagtattgacaaccttcgccacagaaggtggaggcaaatacaccatgctgtcactagaccgccacatagccatc

SEQ ID NO: 106 - DNA, 7937 bp, Human papillomavirus type 52
ctgtaaaaaaatatggaaaacgtttacgcctgcgacgtagtaaaaaataactaggatgtaaaataaaatctgtaccatcaacaataatagatgtagatggagctgtaggggctataggaacaaaaggagtatgtgtgggtaacgaaggtaatggaatgtcaggacctgactcaatggacatagtgggttgatatacaaagtcaataccactattaataggtacagtgaaagtattattatgggtagaaagtgtggaaggtaagtgaaacgtgggttgctgcaaagaatctgcatacacatcatacaaaccatcattaatagtgtaaggggacacagactgtggtaataaaggttgcaattctatgtcttcctgaacttcagcaggctggataggactaatatcatgataataatgtacccgtgccccaatttgttttccactacgtgtacgtagggtggccttattaccaagcctgctaaacctaacagtacctcttcgagaggttaatgcaggcctatgcaaagctataatgtctaaaaaatcaggatccggtgcaggtaaaagttgtgaacgatcaaaaattatagtttcatctgtatcaacgccctcaaaaacaggattgttatatgttactaatttctgtggtgatgacataaaagcagggtcgactaccttaacctgttgtgtggcacggctatataaaccaaggcgtgtcgtagggcgagaccctggaataggtgtactacttgttacactgctgctgtcagtagaggtaacaaatgtatccatagggatttcttcataggtgtgtgtactaatagttggactagaaaacaatacatgaccagatgcttctgcaggtgccgggggctgtattatagatggttcagtgaatgtaggatttaaatgtgtagaaactgattgtacagatgattcacctatagatgttacattaattattgcaggagtattatttgcagatgttgtaacatcaaaccctgttgctgatggaatagatggagcaggtgcgccagactcaataaatgttgtttcttctatcatagaaactatagatggttctaagggaccaatgggttctacagttacagggggacgaatggtggacgtggtaatactactagtgggaggacgagtggacaatggcacatagcctgccctaccaccagagcctgcacctgtacctatacccaaacctccaaaaaacacccctaggctgccatattttaaaagttgatctgcaatagttgtgccttccactttaggaataacatcgggggggcaggtgccagaggctttgcatgtttgatatagctgtgttgcagaagcacgtttgtgccgtgtagaccgtctgtatctcattgcgacaagctattaaaaaatataaaagtatttattagacaaactacaaaagtgaaaaagtatattttgcatatatgcatgtagccaatctacatgtacagttattgcagttgtgccaaatactgtgcatgacagtgaatacaaaacattggaaaatataaaaacagtaggtacaaaaaaaacactttaaatggtgacccaatagatacccatagcaaaagcaccagcaccaacacctgcgcatacaccgatatagatagcaagagcggcctaagcactgcacaaaacaccataagcaaaataaaacaaaatacaaataatcctaacattgttatatatacacaatagcagcaatattggcttgtgttgggtgtttaccatacacatatacatatatacatatgtacaaatatcacaatgacatgacaccttgtataacttgcacagtatttggtattttaacagtttttaaaaattgttgacgttgtgtttcatcactgtacgttattgttacaatacctagtttattatttgtacattcattactggtccaatgccaggtagatgaaatttgaacatacaaacttttatgtgtttttaccctatatcttaaacattttaaactattaggatcaccttttaggtgtattataggtgcagtacaagttgtatgtgcaacccgtcctttgtttgtgcactcagttgcagtgacgagtccccgtgtagtactgtccacggattgttgtccccgcaaaaggttgttggggtacttggtgtttctggagtctgtgacgtctggtcgtcgtcgtttctgtggtggttgtaggtgtgtgtctttggcacccacggacactgcggaggtcttggaggtttcggtgcataggtggacagcagtttcagtagtggatacttcgttactagatacagatgcaggacaaacaattacctgaccacccacatgtacttcccatactcctgttacacaatattgctttgcatcgttactaaattttacaaaatatattttttctccatcacaccaataatataacccatagtaatctacttgtccttctacaattgtacattcacactcaccaagtaaataaatttccttccagtttgtataatccatagtattgttttatcattatcgtattgcactgttattgtatacccatgttttttaaagtatttttgtggttctgcacgccacatttctagacttgtttgttgtaatgtccatccatctgtgctatattgtgttttgtttaatgcctccaatgccaattgtagttcaatagcttggcaggcctttgccttagacactgccattggtggcaccacctggtggcctatatgagttattcccagttcctttgctttgtaaaacaaaacacattccattcgagtcaatttccaatgttcaatttgtgcgtttaggtcattactatcagcttcgtatagatctagtattttttcctgcactgcatttaaacgtgccggtatcgactccatcgttttccttgtcctcttcctgtattaaatctaatttgcaccacgtccttgagaaaaaggatttccaattttcgttgttaatttcatatataggattgccattttcatcaaatggaaatgggtttttgaaatgaaacacaaccaatctactatgtaaatatggccacctaggatctgttcctgcatttgtatttgttgttaaaattaatggtgggcattttatttgtactaaggctctatgctttacatctactgatatatcatttccatccagtgcatttctcatataatcatctatatatgtccaacatataggtgttacatcatctatcatacccacttttgcatctgttaatggttgtagccaaaaatggctttttgagtttacataggatattacacatccacttaagaacctaattaaactcattccaaaatatgattttcctgtgtttgcaggtccatataatactaaacaattttttttaggtataccttttaaaaattttttaaatgcgtctaaaaaggctgtaaattctatgtcttgatatcttaaaaatcttactataggcctccaatctccaccatcatctattctatcacatctatactgtatccattgtccaatattcatatgttttctttctgcccgtttataatgtctacacatggttgcacagtcctttactatttttgcttgcgaattgctttttaggaatgctgcagcattgctatttacatctgctaactgtgcatatttatatgctatgtcactatcatctgttatatcatgatcatatgcccattgcaccatttctccaaaatcgaatatgctattgtcaaagctatgctgtaatactgtttgttgttctatccattctggggtggtaccatatacctcactaatattagacaaacctgttctataccaatataatgcacaggtagcacttcgtaattttggtggttctattaccatatgtgtttctggtatatttaacagctgtgacattagtttggacactgttaatctgttttttccacatttaaacctaattagcagcagtataagcacgcctctgtcacatgttaaacattgcaaatgggcatatatgctatagggctgtattaatacttttaatccttctgcaactgatggtgttactcccattcctataatacaccaatctgtacaactacttctattacttttaaatggtcttactaattccataaagctaacaccatatgtttctttaaatttaaataatacagttgtttttatgctattttcgcacataatattttgtatgctttttagcgttctattactattttcctcattgtcctctatactagtacaacttacatctgaattactagcccccaccccacttgattgactactgttactttgccagtcgccattttgcccgtctacctggtctgccatctgctgcgcttccacttcactattgccatagccgctgtcttctacgtgacatggtttgcgttttggtaaaacacactctgtatttacacaaatgtgttttgcacgcggactaccatgtttttctacaccatcttgcccagcactttccggactgcttgtaaactttcgttttactgcagacacagcatgtaaatcatcctccccttcctgtgcattaaacaatgcccgggctgcctcatgttctgcctgttcattatttatatttgaatcatctataaaatctattagatctgttccactatcatatgcattttcatcctcgtcctctgaaatgttatctcctgtttgtttttctattattgcctctacttcaaaccagcctgtacatccctccctttcgccctctgtaccttcagggtcctccattgcagggttgtttatagccgtgcacagccggggcacacaacttgtaatgtgcccaacagcatttgctgtagagtacgaaggtccgtcgcagtgctatgaatgcatagccgtagtgtgctatcacaactgtgacaatatgtcacaatgtagtaattgcttgtggcttgttctgcttgtccatctggccggtccacaccatctgtatcctcctcatctgagctgtcacctaattgctcatagcagtgtaggtcagttgtttcaggttgcagatctaatatataatcttttatagttgctttgtctccacgcatgacgttacacttgggtcacaggtcggggtctccaacactctgaacagcgccctgtccaacgacccataatattatgaaatcgcttgtttgcattaacatgtctttctttttcttcaggacataatggcgtttgacaaattatacatctaatagttatttcacttaatggtttttttaccctctcttctaatgttttcccatacagtgaatattgataatgcctatattcacttatcttagataaaaagcgtaggcacataatacacacgccatatggattattgtctctatatactattcgtaaatctgtaaatagaaacttgtatacctctcttcgttgtagctcttttttgcactgcacacactgcagccttatttcatgcaccgattcttccagcacctcacacaattcgtgcagggtccggggtcgtgttgctggatcctcaaacatggccgtgcgttagctacactgtgttctatatatatacaccggtttcggtctgaccgttttcggttacaccctattttttactagtataagattataatttataattataaaaaaaagtggttgtgggtacggtaaccgtaaccggtcgtgtagtgcacacctggtgagtaacagtatttaatcatgttttacaagacatatttggcgtaggatgtacttgtgtaagccaacactgtaattagtgcattgaaagtttaaataaaatatgtgcctaaaagcagtttaaaacatgcaatgttaggcaatgtattgtttagctgcactgcaggacctgtgagtcagcaagaagtcagtttaggcgggacaacaagtgtagaccagtggactgcaggaaaccaaaggattaagcagtttgctgaaacttatataaaaatagttgttactgtgccaaggacaaccaaagttgtgccaagaccaaccgaattcggttaggatttaaaatggtggatagtacaaaatggtacaaaatggagagtataaggctaattagtagtgtaacaaagtaggacacagggtagggcaggggacacagggtagggcaggagatgcaatagattaggagcaactgtattgttactcatgtgggtgcaaccataacataagactactataaatagtttagtaaatacagtactttattaatacatacacaaaacatacatacaggaactgacaaatacaacaaacatgcacacacatacataacatgcaaacaacacagtacacacacaaaacaattacataacaaacaatggttaccttttaacctgtgtttgacatacacaacacatacatgacacagacaattacccaacagacaatggttaccttttaacctttttcttctttgtggaggtacgtggggccgatgatgcagggcgttttagtttgggcctagcctgtagccctgcctgtaacaaaaacttcctacctaaaggaaactgatctaaatctgcagaaaacttttcttttaaatccacctcccaaaacatatagtcctttaaaggatcttcctttcctttaggtggtgtgtttttttgacaagttatagcagtagaagtgacaaatctgtatgtgtcctccaaagatgcagacggtggtggggtaaggccaaattgccagtcctctaaaatagtggcatccatcttatgaatgtatgtcataacatcagctgttaatgtaattttgcacaattgaaaaataaattgtaaatcaaattcctcgccatgacgaaggtattccttaaaattttcatttttatatgtgctttcctttttaacctcagcacataaagtcatgttagtgctacgagtggtatccacaactgtgacaaacaactgattgccccaacatatgccattattgtggccctgcgcacgttgtaaccagtacggtttattaaataattgggattctgaggttaccatagaaccactaggagtaggaaaaaaagcactgctttgtacagtggcagtattgccagagttagacccttgtatatataaatcacctggcacagggtcacctaaggtaccggccctattaaaaaagtgtctaacaaacatttgctcacgtctaagaaaaaagaacaaactgtcaccatatggctcgctagccatttgcaaataatctggatacttacatacactgctacatatatcaatgggcacatcacttttactagcttgcaaggtattaaaatccatgcaaccaaatcctgtatctaccatgtccccatcctgtattacactgttaatgagctgtaggggaggacaatccccaggatttcctgaattattattacaaggggttcccttaccccaatgttcacctataggaggtttgcatcctaaaatgcataactgagtctgcttataatccatagataaacattccctattatctataccaggtttaccagcatatttgttactggtttcagtatcatcaaacttgtttaataaaggatgcccactaatacccacacctaaaggctgtcccctaccaatttccaagcctgtacaggcccacaccaacctttgggtttctgggttataaaaagatgtatctggaaaaccaaatttattagggtccggcaatttaattctaaataccctgtattgcaggccagacaccttgggaactaaaacttttttaccattaccactactggtgtttttaatagaaaaatagggatgtcctactgttagtaatcgagaactgcctgcataataatagatgcttgtgcgagacacatactcatcagtgcttacaaccttagagacaggtacaggaggcaggtacacagtggcctcactaggccgccacacggacatc

SEQ ID NO: 107 - DNA, 7833 bp, Human papillomavirus type 56
ctgcaaaaaaatagggaatacgtttacggcgcctacgtctaaaaaaatacacaggccataatgcaaaggaggatccctgtatatatacatcatgggtaacatcataaggagactgaggaacaaagggccacgtactggggcctgtaggcaacactatgtcaggacctgaataaaatggtgtttcccacacattacctaaaggggcagttacattagtggtgttactagcaaaagacaatgtggaaggctttataggtaagtgtgcagaaggtgtagcaactgactggctagacaaaccaggtgcttcatcatctatatttgcataaatatcatataggccatcaaatgaattatttgcagacaataatggctgcatttcaatttcctcagcctgtgcaataggacttatatcataataataatgcacacgggcacctatttgtgtgcctctacgtgtttgtatagtagcctttctgccaagcctactaaaacgtacaccacccctacgtgtagtaaatgcaggcctatgtaatgctactatattcataaaatcagggtcaggagccacacccgacggagaaaaagctaaagatgtgtcagtaccttcaaaaagtggattatcagcagatactaatgttgcaggtctatcaagaaatgcagggtcagttaccttaacctgctgaaatgcttttctatataatctaggagctgcaatacgcctaaagcctggaataggagtactactaataggttctgtaccagaaccgtgaacagcaaatgtttgcataggtatttcttcatagctatgtataccagatgtgggtgtgctaattaaaatattgccagacacctcgcctgtttgtggggcctcaataacagggggatcaataaataacggattggttatatgggtactactgacatgtacagtactagaggttggtgtaatatccaacacggcaggtgtagttgttgatgaggatgtaatttcaaatcccccagacccagtaaaattaggaatccctgcaccagattctataacactggactcctcaactaatgtaacaatggaagggtctgtaggccctacggattccacaacaataggtggtcgcgccggagttacatcaactattgtggaaggcctagaccccaatggaacatagcctgcacgacccccagacccagttcctgtaccaatgccaaggcctccaaaatatgtaaataaacttccccattgcaatattttatcagcccatgttttttgctctattttattaacaacatcctctggacatgtaccagacaacttacatgttttatatagttgtgttgcagatgcgcgtttgcgtcgtgtggcacggtgggcaaccatagtagtaacagtactactacatttacatattatttattatccacaaagcatgtaaatatatacacagcacaggacagtaaaaaaatatcaaaaatattataaatgtattaaaaaaggatgtggctataacaaaccaaaacaatattattaataatatacaactggaaaacacagaggcagatagcaaaagcgggacaacatgacacacaagcaaacaaacacaaaagcaaagcgcaaacacaccaataacacaaaaatcaatggttgcaatatatatgcgtagcagcaatgtatggcaggtacacttcacgtatttgtgtgttacaataacacaaatgtatatacaatatatacagcactttatggaaaactcatttgtcccaaactaacctgtacactactgggaatttttacatgacttaaaaagctgtttcgttgtgtttcatccttatatataattgtaattatgctataatttttattgtctgtacttgtccaatgatatgttgatgttacatccacaaacaatgttttatatttttgaaatcgatatctacaacattttaatctgttaggttcaccttttaaatgtactacaggcgtagtcttatcaccagggtggttgttgttgttgatacttctacttctactgtcggtattgtctgtgtcgctgatgtgtgtgtgtgttgtgacacactttgcgtgggactctctggaggagtcaaattctgattcccgtagtctgggtcgttttcctggtctgtgggatactgcggcgtcttggttgcccacggacgtggaggtggtggtggtggtcttgtgggtgttgtattcgttaacagtttcaacaggggatacgttgtatctacaggtactagacacagagtcaggacaataaatactctcattttccatatgtacttcccatatgtttttacacccaaattttttggcctcttgttcaaagtctgtgtagtatgttttgtggccatcatgtacataatatatacctctatagtctaccccagaacacactttttgccacccacaatctccattgtaatatatatatttccaggctacatattgcatacaattgtttttactaccatcaaaccatacttctatatgttgtccttcttttttaaagcattttttaggttcagtaagccatagttcctcgcatgtgtctcttaatgtccactcttcattgttatatattgttgtacttaatgattccagtgctatttgcacttctattgcactacatgcttttgctttacatacttgtaaacaaggcaccatctggtggtttagtacagtaatgtcattttctcttgctttatagtatagcacattttcatgtcgcacagctttccaatattctatatgatctgcaatacatctactatctttttcaaaacagtctagtattttgttctggcacgcatttaaacgttgggaaagcgtctccattgttttctttgtcctcgtcgttatccaaatttaatctggaccacgtccttgtaaagaaacatttccagtttacattacttaattcatatacaggattaccattattatctaatggaaatggattttgaaactgaaacactaacattctactgtgtaaatatcgtaatttagcatctagcataggatttatattggttgtaattagtaatggtggacattttatttgtactaattgtttatgttttctatctaaacttataggatttccatctaccaaattccttaaataatcgtctatatatttccaacatatttctgttgcatcatccaacaacccaagtttagcattgtctaatggctgcaaccaaaagtggctttgtgaattcacaaatgaaatgacagacccttgaaaaaactttataagactcatagcaaagcatgatttacctgtatttggcggtccacaaagtaccaaacagttatgtttaggtgttccttgtagaaataatttaaagtaacttagaaatgaaatgaaatcgaccccttgatatcttaaaaattgtacaatgggtttccaatcacccccttcatctgttttactacatatgtgctttatccactggcacatattcatttgttgctgttgtgcccttttataatgtctacacattattccacaatcctttacatattttgcctgcatattgctttttaaaaaggcttgtgcattgctgtctacatctgctaattgtgcatattgaaacgcaatttggctatcatctgttacttcattatcaaatgcccactgcaccattttagataattcaaattgactatcctgtaaactgtgttgcaattgtgtttgtctttgtatccattctggtgtgtctccatacacatcactaatatttgacattgctgttttataaaaatataaagctacagcaggacttcgtatttttggtggttgaattaacatttgctcctgtggtacatttaatattgagcttaatgcttttgcaattgtttttctgtttttgccacatgtatatctaattagcatcattactataaccccccatgtacatgttaaacattgcatatgataatacatacagtgtggttttattatagtttttagtgcctcggctaatgtttcattaacaccaaatatagcacatatccaatcattgcaacatgtactatcacttttaaacgtacgcaccaattctgaaaatggaataccatacacttctttaaatttataatataatttaccttgtaaattgctacttttaaacaagtcctgcaattgttgtgttggcgtttcattgtttctatcaatatccatatgtattacagagtcctcactattgttactataggtactgttttgtgagcctccattttgtgtattcccgcacccacgtccctgtacctcttcatctacctgttctggtgtttccagagtttccaatgtattgccatacccgctgtcttgtaggtctgataaaataagcctccgttttactccttcccggcacacagtttgctgattactaatatcccttaatggactagctatatactttcgttttagtttttgcaacgtctgtttatctgcatgtgctgtttgtacttgcaacaattgttgactgtttctgcgtctgcctgtatattttgtatatatgaatcgtctataaatccatctaaatctgtatctatttcatcctcctcgtcactttcatcatctgatattttatctcctgtttttttttctacaattgcctctacttcaaaccatccacaacatcccttcccctccccatctgtaccttcaggtgacgccattgcagttagttacttgatgcgcagagtgggcacgttactgttaacgcacccataagcagctgttgtacaacacgcaggtcctctttggtactctgaatgtccaactgcaccacaaacttacactcacaacaaggtacgtgtattaggtaacacgtatgttgtttagcttgtctagcttgctgtggccgctcctgcaaatggtctacttcatcctcatcctcatcctctgagctgtccaattgctcattgcactgtaggtcaatttctgtttgaggtgttagttctaatacaacgtcttgcagcgttggtactttaccatgcatgattatactgtagattctctaggttctctagatgtttgtctccagcaccccaaacatgacccggtccaaccatgtgctattagatgaaatcgtctttttctgtcacaatgcaattgcttttcctccggagttaacggactttgacatctgtagcaccttattaataaatcacataactgttttttagttatactttctagtgtagctccatacactgaatagtcataatacctatattttctaactttactataaaacaataaacatactctgcacactgcataaggaaaatcatccctatacactaattttaattcagtgcatgcaaaattatatacctcagcacgtgttagttcttttttgcaatatacacatgataatctaagatcaattaaaggtatttctaatacctcactcaagtggtgcaggcttcgtggacgttcctgtggattgttgaattgtggctccatggatatgtccacacagaataagctgccttttatatgtaccgttttcggtcttaaacccttttcggtcactcccaatatataaaagtatgattgaaactttcaacaattaaaagaaacctgtttttgcacgaccgtaaacggttttaaaaaatgagtaattgtatgttacatgtttgcaaaacagatactgacagatacttggcctacatagtgtattctgcaagccaaaacaccaaagttgcagacacatgtataaaaatgtgtgcccaacagcactaaagtatgcagataaaagcatagttggcagtcatagtacctgtgagtaatacagggtgcggtactgtacataattcaagtataaaacacaggaaacggcaatatgccaaaggattaactgttctgctgaaaagggccttttggtttaaataatggcactaggccatgcaaccgaattccttttagtttaaataatggcactaggccatgcaaccgaattcggttgcatgtacaaaatggcggaaaaacaacaaaatggagtatgttatggtatatatatgtatgcacaatacacatagtacactgtacacaataacttacaaaacaaaagccacaataatgacacaccttagtttatgcaaccacgcgtaaaagcactcattcatgtttattacagacacacaaacattacacatatatacagtcatacatacaatgaatacacacacaaacatttcacacaaacacaacatacacatacaaagtataaaataaagcacatacacaaacataccatatatacaacacacaaacacagttacacaaacacacaacaacacactaccgccttttacgttttgctggtgtagaggtggaggtaggagcagatcgctttttagaggtagctacagcaggctttgacctagtgcccagttgcattaaaaattttctacccagtggaaattgatccaggtctgtagaaaaactgtcctgtaagttaacatcccaaaatttatatttagctaatgggtcctgtttttctgttggtggctgttcccgttgacatgttatagctgtgcttctaacatatctatatttatcttctaggctggtggccactggcggggataacccaatattccagtcctccagtaggttagcattcatattatgtaaatatgccataacctctgcagacaaagtaattttgcataattgaaaaacaaattgtaattcatattcctccacatgtctaaggtactgattaatttttcgtgcatcatatttacttaactgttctgtagcagtactaatagtcatgttagtacttctagtagtatctactacagtaacaaataattgattaccccagcaaatgccattattatggccttgggcacgttgcaaccaataaggtttattaaataactgtgcctcagacgtaatcatagacccactaggcgtagcaacatatacagaactcggagggggttctctaccattgctaccctttaaatataactctgcaggtattgtttccccaactttaccagccctattaaaataatgtctggcaaataattgttccctgcgtaagtaaaaccacatagaatcaccataggcatctgcagacatttttaaatagtcaggatatttacaggtggattgtacaatgtctaaaggtacctcagccttagattcctgcaacaccttaaagtccatagcgccaaatcctgtgtctatcatgtccccatcctctataggtgtattaattaatgcaagaggcgggcagtcccctgtggtaacttgtgtggacttacacacagcacctttagtccaatgttcacccatagcgggagtacatccaacaatacacaactgtgtttgcttgccatcaactgatatattgtccctactatcttctataacattattatttgctaaattggaactttcagtatcatccagcctattaaacaatggatggccacttagcccagcacctaaaggctgtccgcggcctacctccaaacctacacatgcccacactaaccgttcctggtccggattataaatattagtatctggaagcccaaacttattagggtcgggcaaccgtaccctaaataccctatattgatatgcactaactttgggaatgtttgttttggtattgtccttagtcacagagtaatagggatgtcctacggcaagcaatcgtgaactgcctgcatgataaaatatactagtgcgttttacataggaatccgttgccacaacctttgaaacaggtgttggaggtagatacaccttattttcactaggccgccacgtcgccatc

SEQ ID NO: 108 - DNA, 7846 bp, Human papillomavirus type 58
tctgcaaaaaaatatggaaaacgtttacgtctgcgacgcaaaataaaatagctagggtgcaacataaaatcagcaccatccacaattatggtattaaaaggagttagtggagatataggaataaatggactagacatagatgttacagaagatgcaatgtctggaccaggttccaatgacacaagaggagtgtcaaatccagtatttaatggtatggacacattactggtacgtgtggtggcaaaggacgtatgtgagtgcagaggactctgaaaatcatgtatagtatcagcatcgtcagcataaatatcataaagtccatcattaatactatagggagaaacagaagtatttaaagattgtaattcaaattgttgctgctgttgtacctgttcctggacaggctgtatgggacttaagtcttggtagtaatgtactttagcccctatttgctttccactgcgagtacgaagtgtagccttttgcccaaccctactataacgtacagtacccctgcgagaggttaatgcaggtctgtgtaatgcaacaatatctagaaaatcaggatcaggagcaggcgatatgtcactatgttgaaactgcaatgtgtcctcagggttaaagccttcaaatgctggattatcatatgttacaagtctatgaggagatgttaaaaaagcagggtcaacaaccttaacttgttgggtgttgcgactgtataaaccaaggcgtgccacagggcgagaccctggaatgggtgtgctagacgtgacattgccactgtcagtagaaataacaaaggtatccattggtatgttttcataactatgtgtgctaacagtaggagaggaaaatattaaatgtccagaggcctctgcaggtgcaggagggcggagtacggatggctcagtaaaggagggatttaaatgtgtagaaacagtttgtatagatgattctccaatagaggaaacattaagtattgcaggtgtagtatctgcagaggtggtaatatcaaaaccagatggagtgggaattgatggggctggtgcaccggcgtctataaaactagattcctctattaaagatacaatagaagaatccaaaggccccacagtatcaacggtaactgggggacgtatgggctgtaaaggtatagcctcagacggtggggtactaccaaggggcacatatccagtcctgccacctgtacccgaccctgtaccaatgcctaaacctccaaaaaacacccctaagctaccatatcgtaatatttgatctgctatagtagtgccttcaactttgggtataacatcaggtgggcaggtgcctgaggccttgcatgtttggtaaagttgtgtagcagatgcacgcttgcgccttgtagaccgtttgtgtctcataataagacagtgctaaaaatataaaagtatttattagtaaatgtataaaaataataaaaacaacacacacaacagtaaatatttacaataccataccaccatgtgcagaaccagtatacagttagtcttgttgggttaagtattgtgcatgaaaattaatacacatcattggtatatataaaaatattaagtaacagaaaaaaattcgtagagccgaccccacagacacccaaagcagcaacaccaacaccagcaaccaagcatatatagaaatagatagcaccaatggccgcaaaaaaatgcacaagcataaaaacagtataaaacaaacaacaaaaataggtaatatcattgtatatacacttagcagcacatattggcttgtggtttacatacagtaattgtacaatacaattacaatgacataacaccagtacttatttgcacagtgggtggtattttaacagtgtttaaaaacagttgtcgttgtgtttccgttgtgtatgttacagtaacaattcctactttgtcacctttgtcatcactggtccaatgccatgtggatgacatattacagtataagtctttaaatggttttaatctatatcttaaacattttaaactatttgggtcaccttttaaatgcacgataggtgaaactttagaactacacacgttccgccctttgtatgtacagttagttgtactgtgtagtcctcctcctcgtggtctactgtccacggcgcagtctgtatactttgtggagtactgggtgttgtctctggagtctggtaaatcgagtcgtcgtcgctttgtcccctgtgtactttcgttgttggtggcctcggtggtctttgggtcagcagtttcagtagtggatatttgatcactaggtatagatgtaggacatacaattacccgactacccacatgtacctcccataattgtgttttagagtacttttttgcatcctctttaaaatatttaaaatacgtcttttcattgccatgtatataatacaaccccacatagtcaacttctcctgctaccaaagtacatgttgtttcctcaataatatatatttcactccaatttgtataatccattgtgtttgctttatcattgtcatattgtacagttactgttatgcctttttttttaaagcatttttgtggctctgataaccacacttctaagcttgtttgttgcaatgtccattcatctgttttatatggtgatgcatttaatgtctctaatgccatttgcagttcaattacttgaaacgctttagtctttgatgctaccaatgacggcaccacctggtggcacaaatgtgatattcccatttgtctggctgtatacattatagcacactccatgcgtattagtttccaatgttcaatttgtgatgttaaatcatttttatcagcttcgtatatgtctaggattttgtcctgcactgcacttaaacgtgctgatatttcctccatcgttttccttgtcctcttcctctattaagcctaatttgcaccacgtccttgagaaaaaggatttccaattttcatcatttattttatacactggattaccatttgcatcaaatggaaatggattgttaaattcaaatactgttagtctactgtgcaaatatggccatcgtgaatctttgcctgcatttgtatttgaggtaattattaatggtggacattttaattgtactaatgccctatgttttacatctattgaaatgtcgttaccatctaatgcatttctcatataatcatctatatatgtccagcttatggctgttacatcatctatcatacctagtttagcatctgataatggctgcaaccaaaaatgacttttggaatttacatatgaaataatgcatccttttaaaaaatgtattaaactcattccaaaatatgatttccctgtatttgctgggccacacagtaacatacaacttttttttggtacaccttgtaaaaactgtttaaatgcaactaaaaatgctgtaaattcaatattttgatatcttaaaaattgtactattggtctccaattacctccatcatttgttttttcacacctactttgtatccattgtcccattgtcataccacgcttttctgctcttttataatgtctgcacataacgccacagtcttttactatttttgcttgtgcattgcttcttaaaaatgctgctgcattactattaacatctgctaactgtgcatatttatatgcaatgtcactatcatctgtaatgtcattatcatatgcccattgtatcatttcacttaaatcaaatatatcatcattaaagctatgctgtaacactgttaatctatctatccattctggtgttgtcccttgcacatcacttatatttgacattgctgttctaaaccaatataaggcacatgcttgacttcgtaattttggtggctcgataatcatacatgtttcaggaattgatagtaaattactcattaattttgccacagttaatctatttttgctacatttaaatctaattaacaataataatataattcctctgtcacacgttaaacattgtaggtgtgtatatatactgtgctgtttaattagtacttttaaactttctgctacggagggacttattccataccctgttatacaccaatctgtacagcttgttttatcacttttaaatggtctaactaattccataaaacttactccataagcttctttgaatttatataatagcgttgctttagtattactgttatgtagaatattactaatattttgtaatggaacagtattacaactgtctacatccgtttcactgcttacatctgaactagcccccaccccactagactccgagtcatttaagtctgcgtcgccattttggctttctacctggtgtgccatctgctcagtttccacttcagtattgccatatccgctgtcttctagctcaataatttttcgttttctgtgtgtgcattctttatttttatatttccacgatacacacacatttgcagcccggtccacacagtcctctacagcactttctgagcatgctgcaaactttcgttttagtgcacacacagcatttatatcgtccaccccttcctgtacattaaacaacgctcgggctgcctctgcttctgcctgtgtagtactttgtactgaatcatctataaactctattaaatctgtaccactatcgtctgctgtttcgtcctcatcatctgaaatattatctcctgttcttcgttctattaccgcttctacctcaaaccagccagtacagcccgcccctaccccgtttgtaccttcagggtcatccattgcagatggtgtttattgctgtgcacagctagggcacacaatggtacatgtgcccataagcagctgctgtagggttcgtacgtcggttgttgtactgttgatacacaaacgaaccgtggtgccacaagtgtaacaacaagttacaatgtagtaattagctgtggccggttgtgcttgtccatctggcccgtccaagcctatttcatcctcgtctgagctgtcacataattgctcatagcagaataggtcagttggttcaggatgtaaatctaaaatatattctcttagcgttgggttgtttcctctcatggcgttgttacaggttacacttgtgtttgtctacgtcggggtctccaacacactgcacagcgccctgtccaacgacccgaaatattatgaaaccttttgtttaaatccacatgcctttttttttcttgtggacacaatggtctttgacaaataatacatctaattaatatttcatttaaacacttttttagtgtttgttctaatgtgtctccatatagcgaataattataatgtctatactcacttattttagatagcaatcgtaagcacactttacatactgcaaatggatttccatctctatacactattcttaaatctgcaaatacaaagtcatatacctcagatcgctgcaaagtctttttgcattcaacgcatttcaattcgatttcatgcacagatgtctccaacgcctgacacaaatcatgcaatgtccgtggtttctcctctgcgtcctggaacatagtcctgcagtagcctaccaaaaaatgtctgctttatatatgcaccggtttcggtcagaccgttttcggttacaccctagtttttacaagatttggcattatagtttagtattatataaaatgttgaaacatgaacaatgtgacccaaaacggttagtccacacctggcaataaatgttagtgagtcacttttacaagacatagtttggcataacaaactattgtgcaagccaaaactgcacttaagcattgaaagtaagttaaaatatgtgcctataagcatgtttaaactatgagtataattaaacattttgcaactgcactgcatgtatatatgagtcacatatgcaagtataggcaaaagcagtgcaggaagggaaaggattaactgtattgtttaaattgtagtttaaaaaaaacacgtttgtgccagcaaccgaaatcggttacatgcacaaaatggaggtaaagtaaaatggaggcagtactgttaaaaactataaaatacatatcatacaaatactattacataggtatgcataataggcagggcagggtagggcaatttagggacagcaccttactcatagatacacccaaacaatacaaatagtttacaatacacacaatagtttattacatatatacagaaacaggaaactgacaaggacatagaacatgtacacaaacatgacacataacacatacaacatatacacaaacataaacaaacagacaacacatacataaaacaaacaaacatgtataataaaatagtgtaagtaccacaacaattattttttaacctttttgcgtttggtggatggtgcacgggtagtaggggccgaacgttttagtctgggctttgctttaaggcctgattgtaataaaaactttcgtcccaaaggaaactgatctagatccccctcgactctagaggatctgcagaaaacttttcctttaagttaacctcccaaaaagtatatttatttaatggatcttccttttctttagggggtgctgttttttggcaagtaatagcctgggaggtaacaaatctatatgtgtcctgtaaactggcagacggaggaggtgttaaaccaaattgccagtcctccaaaatattggaatccatagtatgtatatatgtcattatctctgcagttagtgtaattttgcaaagctgaaaaacaaactgtaagtcatattcttcaacatgacgtacatattccttaaaattatcatttttatatgtaccttccttagttacttcagtgcataatgtcatattagtgctacgagtggtatcaaccacggtaacaaataactgattgccccagcaaatgccattgttatgaccttgtgcacgctgtagccaataaggcttattaaataattgtgattctgaggtaactatagagccactaggagttggaaaaaatgcactactttggataactgcagtattaccggaccctttaatataaaggtcatccgggacagcctcgccaagttttccagccctattaaaaaagtgtctaacaaacatctgctcacgtctaagaaaaaagaacaaactatccccataaggttcactggccatttttaaataatctggatatttgcatgtactgttacaaatatcaataggcacatcacttttattagcctgcaatgtaccaaagtccatgcatccaaaccctgtatctaccatgtcaccatcctcaataatagaattaaaaagttccaatggaggacaatcagtagcagctgcattattgttacaggcaacacctttaccccaatgctcaccagtgggaggtttacagccaattaaacataattgtgtttgtttataatccatagataagcattccctgttatcagaccctggctgtgcgggatatctgttactggtttcagtgtcatcaaatttatttaaataaggatgaccacttacgccaacacccaatggctgtcccctacctatttcaaggcctacacatgcccagaccaaacgttgtgtatcagggttataaaaagatgtatcaggaaaaccaaatttattgggatcaggtaaacgcaccctaaagaccctatactgtaagcctgataccttgggaactaatacttttttattgttattgggacttttgatggaaaaatatggattgccaacagccaaaagtctggaactgccagcataataataaatgcttgtgcgtgacacatattcatcagtgcttacaaccttagacacaggcacaggaggcaggtacacagtggcctcactaggccgccacacggacatc

SEQ ID NO: 109 - DNA, 7838 bp, Human papillomavirus type 66
ctgtaaaaaaatagggaacacgtttacggcgcctacgtttaaaaaaatatacaggccatagtgcaaatgtacctccctgtatatatacatcatgtgtaacatcataaggagactgaggtacaaagggccaagtactggggcctgtaggtaaaactatatcaggaccagaataaaatggtgtttcccaaacatttcccaaaggggcagtaacattagttgtgttactagcaaaggataatgtagaaggtttaataggtaattgtgcagaaggtgtagcaccagactgacgaaatgaaatgggtgcctcatcatcaatatttgcataaatatcatataggccatcaaatggattgtctgtagacaataatggctgcatttcaatttcatcagcctgtgcaataggacttatatcataataataatgcacacgagcacctatttgtgtacccctacgtgtttgcatggtagcctttttgcctagcctactaaaacgcacacctgttctacgtgtagtaaatgcaggcctatgcaatgcaactatatccataaaatcaggatcaggagccacacccgagggagaaaaggtcaacgttgtgtcagcaccttcaaaaacaggattatcagcagttattaatgttgtggggttgtccaaaaatgctgggtcagtgaccctaacctgctgaaaagccctactatacaatctgggagcagcaaggcgtctaaaacctggaataggggtactactaataggttcgttgccagtaccgtgtatagcaaatgtttgcataggtatttcctcatagctacgtattccagatgtaggagtgctaatcaaaatattaccagatacctctccagtttgtggagcctcaattactggaggatcaatatatagtgggtttgttatagtagtactacttacatgtacagtactagatgtgggtgtaatatccaacacagcaggtgtggttgtagaagaggatgtgacctcaaagccccctgacccagtaaaattgggaacaccagcccctgagttaataacactagattcttctaccagtgtaacaatagaaggatccgtaggcccaactgactccaccacaataggtggtcgtgcaggagtgacatcaactatagtagaaggcctagagcctaagggaacatagcccgcccgaccacccgacccagacccagtaccaatgccaagtcccccaaaatatgtaaataaacttccccattgtaaaattctatcagcccatgttttttgctctaccttattaataacatcctcaggacatgtaccaggtaatttgcatgttttatataattgtgtggcagatgcgcgtttgcgtcgtgtggcacggtgggcaaccatagtagcaaaaacgtaatactgttacaaatggtttattaaccacaaagcatgaaaatatatacacagtgtaggtatataaaaaaatagtaaaaacagtataaatgtatcaaaaaatgatgtagccacaacaaaccaaaataaagtaattagtataagacaattggtaaacaaagatgcagatagcaaaagcgggacaaaatggcacacacacagacaaacacaaaagcaaagcgcaaacacacaaattacacaaatatcaatggttgcaatatatagcgattacacgttaccgtttccagtgttacaataacacatactataccaaatacaattaatgggtgcaatatatatgcgtagcagcaatgtatggcaattacacttcatatgtatccgtgttacaataacacatatgtatatacaatatatacaacactttatggacaactcatttgtcccaaaataacctgtacactaggtggtatttttacaacatttaaaaaggtgtcccgttgcgtttcatctttatataatattgtaataatactactgtctttattatctgtacttgtccaatgatatgttgttgttacatctgtaaataatgttttatatttttgaaatctgtatctacaacactttaatctattggcttcaccttttaaatgaattgcaggtgtagtcttatcaccacagtggttgtgtgtgttgatacgtgcacttctactgttggcgttgttactgatgtctgtgtctgttgtgacacggtgtgcgtaggactctctggaggagtcaggttctgattcacttgctctgggtcgttttcctggtctgtgggataccgcggcgtcttgggcgcccacagaggtggaggcggtggtggtggtcctgtggttgttgtattcgttaacagtctcaacagggggtacgttgtatctacaggtactagacacagagtcaggacaataaatactctcggtttccatatgtacttcccatatgtttgtacacccatattttttggcctcctgttcaaagtctgtgtaatatgttttgtggccatcatgcatataatatatgcctctgtaatccacccctgatgacactttacaccacccacactctccattataatatataaatttccacaccacatattccatacaattatttttgttaccatcaaaccacacttctatatgttgtccttcttttttaaaacagtttttgggctccgtgcgccacagttcatcacatgtatcacgtaatgtccactcttcatttttatatattgtgttacttattgcttccagtgccatttgtaattctattgcactacatgcttttgctttacacacttgtaaagagggcaccatctggtggtttagtacattaatgtcattttctcttgctttataatataatacatattcatgtcgtacagctttccaatagtttatatgatctataatgcatttactatctttttcataacagtctagtattttgttctggcacgcatctaaacgttgggatagagtctccattgttttctttgtcctcgtcgttatccaaatttaatctggaccatgtcctttcaaaaaaacatttccaatttacattactcaattcatacacaggattaccattgttatctaatggaaatggattttcaaacttaaacactgaaattctactgtgtagatatcctaattttgcatcttgcataggatttacattagttgtaataatgactggaggacattttatttgtactaattgtttatgtttcctatctaaacttatgggattcccatctaataaatttcttagataatcatctatatatctccaacacgtatctgttgcatcatccagcaaacctaatttggcattgtctagtggctgtaaccaaaagtggctttgtgaattaacaaatgaaatgactgacccttggaaaaaatttataaggctcatagcaaaacatgatttacctgtatttggtggtccacacagtaccaaacaattatgtttaggcgtgccttgtaaaaataatttaaaataacttaaaaatgaaatgaagtcgaccccttgatatcgtaaaaattgcacaatgggtttccaatcaccaagccaagcttaattcggcttcccttcatctactttactacatatatgctttatccactggcacatattcatttgctgttgctgtgcccttttataatgtctacacattattccacaatcctttacatattttgcttgcatattactttttaaaaatgcttgtgcattactatctatgtctgctagttgtgcatataaaaaggcaatttggctatcatctgttacgtcattatcaaatgcccactgtaccattttagacaattcaaattgattgtcttgtaaactgtgttgcaattgtgtctgtctttgtatccattctggtgtttccccatacacctcactaatatttgacattgctgttttataaaaatataatgccacagcaggacttcgtagttttggtggttgaattaacatttgctcttgtggtacatttaaaattgagcttagcgattttgtaattgtttttctgttttttccacatatatatctaattagcatcattacaattaccccccatgaacatgttaggcattgcatatgatagtacacacattgtggttttagtatagtttttaacgcttctgctaatgtttcattaacaccaaatattgcacatatccaatcgttacaacatgtactatcgcttttaaatgttcgcaccaactctgtatatggcactccatacacttctttaaatttaaaatgtaatcttccttgtacgttactacttttaaatagttcctgcaattggtgtgttggtgtttccatatttgtatctatatccatatttaccaccgagtgctcactacagttactgttttgcgagcctccattttgtgagctcccgcacccatttcccttttcgtattctacctgttgtgatgtttccaatgtttccaatgtattgccgtacccgctgtcttctgataatattagccttcgttttacttcctcccggtacacagtttgctgattactaatatcacttaagggactacctatatactttcgttttagtttttgcaacgtctgtgcatctgcatgtgctgtttgtacttgcaataattgttgagctgtctccctgtcttcctgtgtattgtttataagtgtattgtctataaatccatctaaatctgtatctgtttcattctcctcctcgctttcatcatctgatattgtatcccccgtttttctttctacaattgcttctacctgaaaccatccacaacatcccgtcccctccccatttgtaccttcaggtgatgccattgcagttatttagttgacgcgcagagtgggcacgttactgttaacgcacccataagcagctgttgtaccacacgtagctcctctttggtactctgaatgtccaactgcaccacaagctcacacttacaacaaggtacgtgaattaggtaacacttatgttgttcagcttgtctagcttgctgtggccgctccagcaaatggtctatttcatcctcatcctcatcctctgagctgtccaattgctcattgcattgtaggtcaatttcagtttgcggtgcaagttctaatataatctcttgcaacgttggtgctttaccatgcatggttatactgtagattctgtggcttgtctactcgtatgtctccaacactgcaaacatgacccggtccatgcatatgctatataatgaaatcgtcttttatgttcacagtgcaattgtttttcctccggtgttaacggacattgacatcggtagcaccttattgataaatcagataactgttttttagttataccttctaatgttgccccatacactgaatatttatagtacctatattttctaaccttactataaaacaataaacataccctacatactgcatatggccaattgtttctatatactaattttaactcaatacatgcaaacctatataactctaaacttgtaagttcctttttgcagtatacacatgataatctaagatcaagtaaaggtatttgtaatacctcgctcagatggtgcaggcttcgtggacgttcctgtgtattgctgaatatggaatccatggatatctacaggcacaacaggctgccttttatatgtaccgttttcggtcctaaacccatttcggttactcccaatataataaagtatgattgaaactttcaacaattaaaagaaacctgtcttagcacgaccgtaaacggttttgaaaaatgagtaagtatatggttacatatttgcaagacagatacttggcttatacaataagggctacacgccaacaaaatatattgcaaacacctgcataaaaacatatgcccaacagcgccaaagtatgcagataaaagcatagttggcacagaaatactggtgagtaatacagggtaaggcagtgtacatacctgaatcatacaacaggaaacggcaatatgccaaaggattaactgttttgctgaaaagtcgttttgggtttaaataaggacaaaaggctaggcaaccgaattcggttgcatgcataaaatggcgtacagcactaaaatggagtttggtatgttactatagtgcatacaaacaacctatttaatataacagtaaacagtaaggaacaccacctaacctgacacacactgcccaaggatactaccgcaccttagtttatgcaaccacgcgtaaaagtaaccatgcatgtttattacatacacacaaaacattacacatacatacagtcatacatacacatagcacatacacaattataaaatacataaacatacacaaaaacatacagtacaagcacaaccatacaatacatacaacagacaacacacaactatcgtcttttacgtttagctggtaaagaagaggaagaggtaggagccgcccgctttttagaggcagatgcactagccttgggtctagggcctagttgcattaaaaattttctacccaaaggaaactgatctaggtctgcagaaaagctgtcctgtaaattaacctcccaaaacttatatttagccaggggatcctgcttttctgcagggggctgttccctttgacatgtaatagctgtgcttttaatatgcctatatttatcctctaagctagttgcaactggtggggacaatccaatgttccaatcgtctaataaagtattattcatattatgcaaatatgccataacttctgcagttaaggttattttacaaagttgaaacacaaactgtagttcatattcctccacatggcgaaggtattgattgatttcacgtgcatcatatttagttaatgtgcttttagctgcattaatagtcatgttggtacttctggtagtatccacaacagtaacaaatacctgattaccccagcatatgccattattatggccctgtgcacgttgcaaccaataaggtttattaaataattgggcctcagaggtaatcatggacccactaggagtagcaacatatacagaactgggaggagggtccctgccattgccacccttccaatacaaatctgtaggaatggcttccccaacattacctgccctattaaagtaatgtttggcaaacaattgttccctgcgtaagtaaaaccacatagaatccccataggcatctgcagacatttttagataatcaggatatttacatgtagattgtacaatgtccaatggcacctcagcctttgattcctgtaattgcttaaagtccattgcaccaaacccggtgtccaccatgtcaccgtcctctattggggtattaactaatgccaaaggtggacaatcccctgtattgactggtgtagacttacacaccgcgcccttagtccaatgttcacctaatgctggcgcacatcccacaatacataactgggtttgtttacaatcaacagatatattgtcccggttatcttctgcaacattattacttgctaaattagagacttcagtgtcatccagcctattaaataatggatgaccacttaacccagcacctaaaggttgacctcggcctacctccaaacctacacaggcccataccaaacgttcctggtcaggattatagaaagatggatcaggaaggccaaacttattaggatcaggcaaccgtaccctaaacactctatactgatatgcactaactttagggatgtttgttttggtaccagatttagaaacagagtaataaggatggccaacagcaagcaacctagagctacctgcatgataaaatatactggtacgttttacatatgtatccgttgccacaacctttgaaacaggtgttggaggtaggtacaccttattgtcactagaacgccatagagccatc

SEQ ID NO: 110 - DNA, 7828 bp, Human papillomavirus type 68; identical to SEQ ID NO: 15

SEQ ID NO: 111 - DNA, 1514 bp, Human papillomavirus type 26
ttttgtttacacacaacagtagagggcaccacctggtggtttatacattgcatgtttccttcacgagctttataaaatattgcacattcatatcgtaccagtttccaataatcaatttgatcagttaatttattactgtccagttcataatagtctagtattttctcctggcacgcatttaaacgctggcaaaggttctccattttctttgtccgcgtcctcctccaaatctaatctggaccaggtggtggaaaaaaagcttttccaatttacatcagtcaatgcatatacaggattcccattgctgtcaaatggaaatgtatttggaaatggtatcactgttactctactatgtaaatacaaaagtgagttatcttcttgaggatttatatttgaggtaattattaatggggggcatgtaacttgcagtaggcttctatgttttctgtctatacaacagggatttccatctaaaaagttacgtaaatatttatcaatatataaccagcagctatatgtagcatcatctaatactgcaacttttgcatcttctaaaggctgcagccaaaaatggctatttgaatttacatatgaaatgactgacccttgcataaattttataaaactcattgcaaactgtgacttaccagtatttggcggtccatatattactatacaattgtgctttggggtaccctttaaaaactgttttaacacttgtaaaaaataaataaagtttacatgttgaaaccttaaaaatttggcaatttccttccacgacccgccctcttctattttagaacatctatattgtagccattgtgacatacacatagatcgtttctgtgctcttttataatgtctagtcatggttgcacagtcttttacatattttgcctgacaattgctttttaaaaaggcagctgcattactatctatgtcagctaactgtgcatatttaaatgcaatttcactatcatctgttatgtcatgatcgaacgcccattgcaccatttttgataaatcaaatgtagcatcatcaaaactatgttctaattgtgtttgtcgtactatccattctggtgtatctccatatgtctcacttatattggacaaccctgttttataaaaatataatgctactgctgtacttcgcaattttggtggttcaattagtaattgcgtttctggcacatttaataacatacataggcagtttttaattgttgttctgttttttgcacatgtaaagcgcactagcattagtactattactccccaattacatgttaaacattgtatatgataatataaacaatattgttgtattaatgatttaatactttctgctacagagcctgccacaccgaatgctgcacacacccaatctgaacagcatgttttgtcacttttaaacacccgtactagttctgcaaaacttacaccatatactgttttaaatttacttaacaatgctgcttttacattactacattttaataattcacatattt

SEQ ID NO: 112 - DNA, 1460 bp, Human papillomavirus type 33
acagttatgtatataatacatacctatataatctactttccctgtaaccatagtacatgtatcttcctctataatatatatttcaccccagtttgtataatccattgtattttttttgtcattgtcatattgcacagttactgtttctccttgttttttaaaacattttggtggttcacaaagccacacctctaagcttgtttgttgcaatgtccattggcttgtactatactgtgatttacttaatgtctctaatgccatttgtagttcaattacttgaaatgctttggtctttgatgctaacaaagaaggcaccacctggtggcataaatgtgaaaatcccatttgtttggctgtatacaataaagcacactccatgcgtatcagtttccaatgttcaatttgtgatggtaaatcagttttatcagcttcgtaaagagctagcattttctcctgcactgcatttaaacgtgctgatatttcctccatggttttccttgtcctcttcctctattaaatctaatttgcaccacgtccttgagaaaaaggatttccaattttcatcatttattgcatacactgggttaccattttcatcaaatgggaatggatttttaaattcaaatactgttaatctactatgtaaatatggccatctagagtctgtgcctgcatttgtatttgaggtaagaagcagtggtggacattttaattgcactaatgccctatgtttcacatctattgaaatttcatttccatctaacgcatttctcatgtaatcatctatatatgtccaacttattggcgttacatcatctatcattcctatttttgcatctgataatggctgcaaccaaaagtgacttttagaatttacacatgatataacacacccttttaaaaactgtattaaactcattccaaaatatgactttcctgtatttgctggtccacaaattagcatacagcttttttttggtataccttttaaaaactttttaaatgcacctaaaaatgctgtaaattcaatgttttgatatcttaacaactgtactattggtctccaatttcctccatcatttgttttttcacatctactttgtatccattgtcctattgacattttacgtttttctgcttttttataatgtctacacattattccacagtcctttactatttttgcttgtgagttactttttaaaaatgcagcagcattactatttgaatctgcaagttgtgcataataatatgcaatgtcactatcgtccgttaactcgttatcatatgcccactgtaccatttcacttaaatcaaatatattatcattaaagctatgttgtaaaacagttagtctatctatccattcaggtgttgtaccttgtacatcactaatgtttgacattgctgttctaaaccaatacaatgcacatgtttggctccgtaattttggtggctct

SEQ ID NO: 113 - DNA, 1962 bp, Human papillomavirus type 56
ctctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtaccgggccccccctcgagatggcgacgtggcggcctagtgaaaataaggtgtatctacctccaacacctgtttcaaaggttgtggcaacggattcctatgtaaaacgcactagtatattttatcatgcaggcagttcacgattgcttgccgtaggacatccctattactctgtgactaaggacaataccaaaacaaacattcccaaagttagtgcatatcaatatagggtatttagggtacggttgcccgaccctaataagtttgggcttccagatactaatatttataatccggaccaggaacggttagtgtgggcatgtgtaggtttggaggtaggccgcggacagcctttaggtgctgggctaagtggccatccattgtttaataggctggatgatactgaaagttccaatttagcaaataataatgttatagaagatagtagggacaatatatcagttgatggcaagcaaacac

SEQ ID NO: 114 - DNA, 1634 bp, Human papillomavirus type 66
cgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgcctgtaaaaaaatagggaacacgtttacggcgcctacgtttaaaaaaatatacaggccatagtgcaaatgtacctccctgtatatatacatcatgtgtaacatcataaggagactgaggtacaaagggccaagtactggggcctgtaggtaaaactatatcaggacca

SEQ ID NO: 115 - DNA, 320 bp, Human papillomavirus type 66
gcgtgccttgtaaaaataatttaaaataacttaaaaatgaaatgaagtcgaccccttgatatcgtaaaaattgcacaatgggtttccaatcaccaagccaagcttaattcggcttcccttcatctactttactacatatatgctttatccactggcacatattcatttgctgttgctgtgcccttttataatgtctacacattattccacaatcctttacatattttgcttgcatattactttttaaaaatgcttgtgcattactatctatgtctgctagttgtgcatataaaaaggcaatttggctatcatctgttacg

SEQ ID NO: 116 - DNA, 7856 bp, Human papillomavirus type 26
ctgaaaaaaaataaggcatacgtttacggcgtttatggattaaataaatatagggccataaataataattatccccatgcacaactattgcaggtaagttagtggtgggtggggggggcaatgatggccatgtcggggaagatgtgggcgtgtaaatgtctgacccactatatacaggtagttcaaatgaggtggataaaggcacagtaacattggtagtggaagtattaatagaggaaaacacattggaggcatatcttggaactggtaatgttgtaggggaatatgacatgcgcggcgtatgtatgctaggaactgtatcagggtctgcatatatatcaaacaaaggtgcagatgaatgggtagatgtatgtaaaggctgcaattcaatttcttcgtgttcagcaaaagactgtataggactaatatcatgataataatgtactgtagctccaatttgttttccactacgtgttttcatagtggccttttgacccaacctactatagcgtacagtacctttgcgagatgtaagggccggacgatgcaatgcaataatgtccaaaaaatcggggtcaggtgctacagtactactggaagcatatgtaagtgtttcatctataggttcatatgcaggattatcaaaggtaacaaatgtggagggattaccaataaaattgggatctgtaacctttacctgttgataggccttactatacaaacgaggagctgacactcgttgtataccaggaataggtgtactactaataggttctaatcctgttccattagtagaagcaaatacttccattggaatttcttcataactatgtgtgccagctgtggacgttgtagtaaatatatgacctgatgcttccccggcctgtggtatatctatagggggttcaatatataatggattttgtatattggtacttgttacatgtacagtaccagcagagggggtgatgtccaacacagcaggtgttgttgcagaggatgtggtaagttcaaagccattgccaccactaaatgtaggtataggggctccagattgtataatactagattcctccaccaaagtaactatagaaggttctgtaggacccacaggttcaataataatgggcggacgggtagggccgatatccacaacagagggtctaccaccccctcctaggggaatgtatccagtacgcccaccagacccagttcctgtacctataccaagaccacctaaaaatattcccaaaccactccattgtaatatcttatcagcaagggtagaaccttcaattttaggaataacatcaggagggcacgtaccagcggccttacatgttttgtataagtctgtagctgatgctcgtttgcgtcgaggggcacggacagctaccattgtaacacgtttattaaagggactaagtagcaattaccattacagtataaaaatgtaaaaaacaagcaggtataaaaaataagcaaatatacacaatataggtagttatatatgatgtagataccacaaaccaaaaacaaaacactaataatagcgaggctgcaaacacataaatggaaagcaaaagtggcaacaaacaacacagcaacacacacacacacacgcaaagcacaaacacataaactataaaaggaataatgattacaggtatataggtgtgttagcagcacatattggcttgtgtgttggtaaaatatacactatattacaatgacattattcccaatgttgaagttatactttgtggtattttaacagttgttaaaaaattattacgttgtgttatactgttaaaggtaattgttacaatgccttgttgattggtatcattactggtccaatgccaggtagatgatacattgcaatacaatcctttatgctttttaaatctatatcttaaacattttaaactatttgtatcaccttttaggtgtactataaacacagtttggtcactactcgtgtcccttcccgggtgatggcctccacttgtactgtgtaggttgttgtttgtatagtccactgactgtccgggctgtgtggcagctgtggtgacagtggtgactgtggtgacggtggtgtcaggtccactgagtcgtcgtcgctttcctgggtatggcgcctcggtttccttggtgcccacgggcacgtaggcttcggtggtctgggtggtggcgtttgatactggctcagcagttttagcagtggatatttggttgctgctgcaggtactagatacaaattcaggacaacagattacctgaccacacacatgtacagcccattgcacacctgtcccatatttttccgcctcttgtttaaagtccacgtaatactgcttatatgccccttgtgtataatatatcccttttgcatcaacatctccagtacctttacaccaccctatatcagttttataatacacatatttccacctaatataatccattgtattttccttattacaatcaaataccactgttaccgttgttccttcttttttaaaacaatgtttaggttctgtcatatacatttcatagcttgtgtctcgcattgtccaagcttctgtattatagtccgtgtttattaacgactgcaatgctatatgtatttcaattgcctgccatgccttttgtttacacacaacagtagagggcaccacctggtggtttatacattgcatgtttccttcacgagctttataaaatattgcacattcatatcgtaccagtttccaataatcaatttgatcagttaatttattactgtccagttcataatagtctagtattttctcctggcacgcatttaaacgctggcaaaggttctccattttctttgtccgcgtcctcctccaaatctaatctggaccaggtggtggaaaaaaagcttttccaatttacatcagtcaatgcatatacaggattcccattgctgtcaaatggaaatgtatttggaaatggtatcactgttactctactatgtaaatacaaaagtgagttatcttcttgaggatttatatttgaggtaattattaatggggggcatgtaacttgcagtaggcttctatgttttctgtctatacaacagggatttccatctaaaaagttacgtaaatatttatcaatatataaccagcagctatatgtagcatcatctaatactgcaacttttgcatcttctaaaggctgcagccaaaaatggctatttgaatttacatatgaaatgactgacccttgcataaattttataaaactcattgcaaactgtgacttaccagtatttggcggtccatatattactatacaattgtgctttggggtaccctttaaaaactgttttaacacttgtaaaaaataaataaagtttacatgttgaaaccttaaaaatttggcaatttccttccacgacccgccctcttctattttagaacatctatattgtagccattgtgacatacacatagatcgtttctgtgctcttttataatgtctagtcatggttgcacagtcttttacatattttgcctgacaattgctttttaaaaaggcagctgcattactatctatgtcagctaactgtgcatatttaaatgcaatttcactatcatctgttatgtcatgatcgaacgcccattgcaccatttttgataaatcaaatgtagcatcatcaaaactatgttctaattgtgtttgtcgtactatccattctggtgtatctccatatgtctcacttatattggacaaccctgttttataaaaatataatgctactgctgtacttcgcaattttggtggttcaattagtaattgcgtttctggcacatttaataacatacataggcagtttttaattgttgttctgttttttgcacatgtaaagcgcactagcattagtactattactccccaattacatgttaaacattgtatatgataatataaacaatattgttgtattaatgatttaatactttctgctacagagcctgccacaccgaatgctgcacacacccaatctgaacagcatgttttgtcacttttaaacacccgtactagttctgcaaaacttacaccatatactgttttaaatttacttaacaatgctgcttttacattactacattttaataattcacatatttgtgtaacactgtttacatgtgtgtctacatcgatatcttccactgaggcatttgaccccccctgactacacacactaggcaacccgccattttcttcatattgtttatctacctgtacgggcgtaagagtttccacttcagtatagccatacccgctgtccggtacactgtccacggctctccttttggcctgtgaattatttacttggtgtgtattctgctgactgtcgctttgctgtctgtgttgatttgttatgtcttgcaacgggctgttctgactacctagtaactttcgttttaaattgcgcactgcctttgtatttgcctgtttttgttgtgcctgaaacaatgcctgggttacctcctgttctgcataatcacttatactactatcatctataaatcctattaggtccgaccctgtatcactactattgtctgtttcatcatctgatattgtgtcccctgtatgtttttccactatagcttctactgaaaaccaccctgtacacccccgcccctcctcatttgtaccttcacagtccattgcaggtttactgtgcagcacactgatggcacaccaaggacacgtcttccattaacatctgctccagcactcgaacgttctgtcgactgctctgcacagctagctgcactatactattacacatacaacattgtgcttcaattctgtaacacacttcttgtccagcttgtctggcctgctggtcacgcatattatctgtttcatcctcatctgagctgtcaaattgttcatagtccaattgttcgtagcagcgtaggtcaatttcgggttgcggcaccagatctagtattacatcttcaatattaattatgtttccatgcattgttctttacacttgtgtttctgtttggcgccttggtctccaacaatttgtacacaaccctttccactgccctgctatttcgtgaaatcgtcgcttttcatccacaattctttgtttttcttctggccccaatggcatttgacatctatgacaccttattaacaaattacataaactttttttagttaaggcttctaatgttgcaccatacacagaacatgtatagcgtctatactctgttatttttgaataaaatattacacatcttttgcatgcagcatacggactcctatctctatatactactcttaggtcacaaattgcaaaattatatacatcagcccattgtaaggtttccttgcaatatacacactgtacctgcaaattttgcaaagtagtattcaagctttcacatagctcatgtagcgttctgggtcgttctctaggatcctcgaacatagctgttttgcacgtagctagccttttacttttatatgtaccggtttcggttgcaaccgttttcggttacacccttttagtaacatataattgttaaaagttattataaagaaacttgcatgcattaacaaaacacatttcggttacatacacacctgtgtttaactatgggttacaacagtatgtgtcagacacatagttggcaaacaaaagtgtatatgttagccaactatgcacttaaaagacctataaaataaaataaaaatatgtgcctaacagcagttttattataatgtaagaaaaagtgcttatgtaagtattgtttaaatatatgtgactaatacaggcgcgccacttatagtgccaaaatggcaagccaagcgtaggaggcaggatgtgttgtctgccaaaggattaactgttcctgcaggatacagcatgaaagttggataaaaactaaaataaggaacgaccgaaaacggttgggacaatagatagtaatagaaaatataaaaagtaaaaatataacactacaaaagtttagtgaaatacatataaaaggtaaacttgtgtaatataataattataagggacaccacctaaggttcctcccattacctcaggggtaaaacaaatgacaaatagtgtagtaaagacatgtaaccatgcatgaagacacattcatactttattaaataacaagtatgcatacaaacaggaaaacacataaccatgcatacatataatacatacatacaaaacacgcctttacattacatacagttgtacacacatacaaacacaccttacataacataccacaaacatatacacacacacaaacatgcggaattatttagtaagtttacgttttttgcgtttggtagaggaagaggtagaagataagggacgtttggtgcctagtttcggccgccgttgtatgccggcctgtaacataaacttacgccctagtggaaattgatccaaatcaatagaaaatttttcttttaaatctacatcccaaaatttaaatttttgaaaaggatcttcctttggcacaggaggggcgttacgctgacaggtagtagcagagtttttaataaacctataggcatcttccaaactagcagtgggaggtaaggttagtccaaaattccaatcctccaatatggaggcattcattaaatgtatgtaagccataacatctgttgtaagtgttattttacacaactgaaatataaattgtaattcatattcttcgccatgtcttataaattgtttataatcagatggtttaaatggagtggatgcagatgctgcagataatgtactaatggtaaggttagtactgcgggtggtatcaacacaggtaacaaacaattgattgccccaacagataccattattatgaccctgtgcacgttgtaaccagtatggcttattaaatagttgtgcatccgaagtaaccatagagccactaggtgtagcagaataaatagaagatgtagggggctccctgcctgattcagcacctttaatatacaaagtggtgggtatagcatccccaacagcccccgccttattataaaaatgtctggcaaataattgttcccggcgaagaaaaaaaaacatgctgtttccatatgtatctgcagacattttaagataatcaggatatttacatgtggattgactaatatcaatgggcacatctgatttggtagcctgtaaggcagtaaaatccatagctccaaagcctgtatcaatcatatcgccatcctcaataatgctggaaattaattctaagggggggcaatccccacgttgtgtctgtgtatttttacatatagtgccaataccccagtgctctcccaagggcggtgtacaacctataatacataactgtgtttgtttattatcaactgaaacattgtccctgttgtcagtgtctgcatttacagtagccaaatgagagttttcggtatcatccaacttattaaacaaaggatgtccactaaggccaatgcctaatggctgtcctctaccaacttcaacaccaacacaggcccacaccaggcgttctgtgtcaggattatataactgtggatcaggcaatccaaatttattaggatcaggtaggtgcactctaaataccctgtactgataggcagataccttaggaatttcggccttttggccagttttaggtatggaaaaatatggatgtcctaatgttaataaacgagagctgcccgcataataatatatgccggtgcgagttacatattcatccgtgttgacaacccgagacacaggggtgggaggaagatataccttgctgtcactagtacgccacaaagccatc

SEQ ID NO: 117 - DNA, 5820 bp, Artificial Sequence
  HPV 26 deletion probe
  misc_feature (1)..(5820): n is t or u
cngaaaaaaaanaaggcanacgnnnacggcgnnnanggannaaanaaananagggccanaaanaanaannanccccangcacaacnanngcaggnaagnnagnggngggnggggggggcaanganggccangncggggaagangngggcgngnaaangncngacccacnananacaggnagnncaaangaggngganaaaggcacagnaacannggnagnggaagnannaanagaggaaaacacannggaggcanancnnggaacnggnaangnngnaggggaanangacangcgcggcgnangnangcnaggaacngnancagggncngcanananancaaacaaaggngcagangaangggnagangnangnaaaggcngcaanncaannncnncgngnncagcaaaagacngnanaggacnaanancanganaanaangnacngnagcnccaannngnnnnccacnacgngnnnncanagnggccnnnngacccaaccnacnanagcgnacagnaccnnngcgagangnaagggccggacgangcaangcaanaangnccaaaaaancggggncaggngcnacagnacnacnggaagcanangnaagngnnncancnanaggnncanangcaggannancaaaggnaacaaangnggagggannaccaanaaaanngggancngnaaccnnnaccngnnganaggccnnacnanacaaacgaggagcngacacncgnngnanaccaggaanaggngnacnacnaanaggnncnaanccngnnccannagnagaagcaaanacnnccannggaannncnncanaacnangngngccagcngnggacgnngnagnaaananangaccngangcnnccccggccngnggnanancnanagggggnncaanananaanggannnngnanannggnacnngnnacangnacagnaccagcagagggggngangnccaacacagcaggngnngnngcagaggangnggnaagnncaaagccanngccaccacnaaangnaggnanaggggcnccaganngnanaanacnagannccnccaccaaagnaacnanagaaggnncngnaggacccacaggnncaanaanaangggcggacgggnagggccgananccacaacagagggncnaccacccccnccnaggggaangnanccagnacgcccaccagacccagnnccngnaccnanaccaagaccaccnaaaaananncccaaaccacnccanngnaanancnnancagcaagggnagaaccnncaannnnaggaanaacancaggagggcacgnaccagcggccnnacangnnnngnanaagncngnagcngangcncgnnngcgncgaggggcacggacagcnaccanngnaacacgnnnannaaagggacnaagnagcaannaccannacagnanaaaaangnaaaaaacaagcaggnanaaaaaanaagcaaananacacaananaggnagnnananangangnaganaccacaaaccaaaaacaaaacacnaanaanagcgaggcngcaaacacanaaanggaaagcaaaagnggcaacaaacaacacagcaacacacacacacacacgcaaagcacaaacacanaaacnanaaaaggaanaangannacaggnananaggngngnnagcagcacanannggcnngngngnnggnaaaananacacnanannacaangacannanncccaangnngaagnnanacnnngnggnannnnaacagnngnnaaaaaannannacgnngngnnanacngnnaaaggnaanngnnacaangccnngnngannggnancannacnggnccaangccaggnaganganacanngcaanacaanccnnnangcnnnnnaaancnanancnnaaacannnnaaacnannngnancaccnnnnaggngnacnanaaacacagnnnggncacnacncgngncccnncccgggnganggccnccacnngnacngngnaggnngnngnnngnanagnccacngacngnccgggcngngnggcagcngnggngacagnggngacngnggngacggnggngncaggnccacngagncgncgncgcnnnccngggnanggcgccncggnnnccnnggngcccacgggcacgnaggcnncggnggncngggnggnggcgnnnganacnggcncagcagnnnnagcagngganannnggnngcngcngcaggnacnaganacaaanncaggacaacagannaccngaccacacacangnacagcccanngcacaccngncccanannnnnccgccncnngnnnaaagnccacgnaanacngcnnanangccccnngngnanaananancccnnnngcancaacancnccagnaccnnnacaccacccnanancagnnnnanaanacacanannnccaccnaananaanccanngnannnnccnnannacaancaaanaccacngnnaccgnngnnccnncnnnnnnaaaacaangnnnaggnncngncananacannncanagcnngngncncgcanngnccaagcnncngnannanagnccgngnnnannaacgacngcaangcnanangnannncaanngccngccangccgngnaacacngnnnacangngngncnacancganancnnccacngaggcannngacccccccngacnacacacacnaggcaacccgccannnncnncananngnnnancnaccngnacgggcgnaagagnnnccacnncagnanagccanacccgcngnccggnacacngnccacggcncnccnnnnggccngngaannannnacnnggngngnanncngcngacngncgcnnngcngncngngnngannngnnangncnngcaacgggcngnncngacnaccnagnaacnnncgnnnnaaanngcgcacngccnnngnannngccngnnnnngnngngccngaaacaangccngggnnaccnccngnncngcanaancacnnanacnacnancancnanaaanccnannaggnccgacccngnancacnacnanngncngnnncancancngananngngnccccngnangnnnnnccacnanagcnncnacngaaaaccacccngnacacccccgccccnccncannngnaccnncacagnccanngcaggnnnacngngcagcacacnganggcacaccaaggacacgncnnccannaacancngcnccagcacncgaacgnncngncgacngcncngcacagcnagcngcacnanacnannacacanacaacanngngcnncaanncngnaacacacnncnngnccagcnngncnggccngcnggncacgcanannancngnnncanccncancngagcngncaaanngnncanagnccaanngnncgnagcagcgnaggncaannncgggnngcggcaccagancnagnannacancnncaanannaannangnnnccangcanngnncnnnacacnngngnnncngnnnggcgccnnggncnccaacaannngnacacaacccnnnccacngcccngcnannncgngaaancgncgcnnnncanccacaanncnnngnnnnncnncnggccccaanggcannngacancnangacaccnnannaacaaannacanaaacnnnnnnnagnnaaggcnncnaangnngcaccanacacagaacangnanagcgncnanacncngnnannnnngaanaaaanannacacancnnnngcangcagcanacggacnccnancncnananacnacncnnaggncacaaanngcaaaannananacancagcccanngnaaggnnnccnngcaananacacacngnaccngcaaannnngcaaagnagnanncaagcnnncacanagcncangnagcgnncngggncgnncncnagganccncgaacanagcngnnnngcacgnagcnagccnnnnacnnnnanangnaccggnnncggnngcaaccgnnnncggnnacacccnnnnagnaacananaanngnnaaaagnnannanaaagaaacnngcangcannaacaaaacacannncggnnacanacacaccngngnnnaacnangggnnacaacagnangngncagacacanagnnggcaaacaaaagngnanangnnagccaacnangcacnnaaaagaccnanaaaanaaaanaaaaanangngccnaacagcagnnnnannanaangnaagaaaaagngcnnangnaagnanngnnnaaananangngacnaanacaggcgcgccacnnanagngccaaaanggcaagccaagcgnaggaggcaggangngnngncngccaaaggannaacngnnccngcagganacagcangaaagnngganaaaaacnaaaanaaggaacgaccgaaaacggnngggacaanaganagnaanagaaaananaaaaagnaaaaananaacacnacaaaagnnnagngaaanacananaaaaggnaaacnngngnaananaanaannanaagggacaccaccnaaggnnccncccannaccncaggggnaaaacaaangacaaanagngnagnaaagacangnaaccangcangaagacacanncanacnnnannaaanaacaagnangcanacaaacaggaaaacacanaaccangcanacananaanacanacanacaaaacacgccnnnacannacanacagnngnacacacanacaaacacaccnnacanaacanaccacaaacananacacacacacaaacangcggaannannnagnaagnnnacgnnnnnngcgnnnggnagaggaagaggnagaaganaagggacgnnnggngccnagnnncggccgngnaaccagnanggcnnannaaanagnngngcanccgaagnaaccanagagccacnaggngnagcagaanaaanagaagangnagggggcncccngccnganncagcaccnnnaananacaaagnggngggnanagcanccccaacagcccccgccnnannanaaaaangncnggcaaanaanngnncccggcgaagaaaaaaaaacangcngnnnccanangnancngcagacannnnaaganaancagganannnacangngganngacnaanancaangggcacancngannnggnagccngnaaggcagnaaaanccanagcnccaaagccngnancaancanancgccanccncaanaangcnggaaannaanncnaagggggggcaanccccacgnngngncngngnannnnnacananagngccaanaccccagngcncncccaagggcggngnacaaccnanaanacanaacngngnnngnnnannancaacngaaacanngncccngnngncagngncngcannnacagnagccaaangagagnnnncggnancanccaacnnannaaacaaaggangnccacnaaggccaangccnaanggcngnccncnaccaacnncaacaccaacacaggcccacaccaggcgnncngngncaggannananaacngnggancaggcaanccaaannnannaggancaggnaggngcacncnaaanacccngnacnganaggcaganaccnnaggaannncggccnnnnggccagnnnnaggnanggaaaaananggangnccnaangnnaanaaacgagagcngcccgcanaanaananangccggngcgagnnacananncanccgngnngacaacccgagacacaggggngggaggaaganana

SEQ ID NO: 118 - DNA, 42 bp, Artificial Sequence
  HPV26XR1 deletion primer
acggcatggcaggcaattgaaatacatatagcattgcagtcg

SEQ ID NO: 119 - DNA, 40 bp, Artificial Sequence
  HPV26XR3 deletion primer
actggttacacggccgaaactaggcaccaaacgtccctta

What is claimed is:

1. A strategically truncated polynucleotide probe at least 1 kilobase in length and sharing 70% or more identity with a sequence selected from the group consisting of SEQ ID NO: 1 to SEQ ID NO: 17, SEQ ID NO: 104 to SEQ ID NO: 110, SEQ ID NO: 116, and full-length complements thereof, wherein:
said polynucleotide probe comprises at least one sequence having from 70% to 100% complementarity to at least 100 contiguous bases of each of L1, L2, E1, E2, E4, E6, and E7 of a HPV nucleic acid selected from the group consisting of SEQ ID NO: 1 to SEQ ID NO: 17, SEQ ID NO: 104 to SEQ ID NO: 110, SEQ ID NO: 116; and
wherein said polynucleotide probe does not contain any sequences of at least 100 contiguous bases having about 70% to 100% complementarity to at least 100 contiguous bases of SEQ ID NO: 18 to SEQ ID NO: 43 and full-length complements thereof.

2. The polynucleotide probe of claim 1, wherein said polynucleotide probe does not comprise any sequences having about 70% to 100% identity to SEQ ID NO: 44 to SEQ ID NO: 57, SEQ ID NO: 111 to SEQ ID NO: 115, and full-length complements thereof.

3. The polynucleotide probe of claim 1 comprising a sequence having about 70% to 100% identity to a sequence selected from the group consisting of SEQ ID NO: 97 to SEQ ID NO: 103, SEQ ID NO: 117, and full-length complements thereof.

4. The polynucleotide probe of claim 1 consisting essentially of a sequence selected from the group consisting of SEQ ID NO: 97 to SEQ ID NO: 103, SEQ ID NO: 117, and full-length complements thereof.

5. The polynucleotide probe of claim 1 consisting of a sequence selected from the group consisting of SEQ ID NO: 97 to SEQ ID NO: 103, SEQ ID NO: 117, and full-length complements thereof.

6. A kit comprising at least one polynucleotide probe of claim 1.

7. A method for generating a polynucleotide probe of claim 1, said method comprising: a) providing a template nucleic acid comprising a sequence at least 1 kilobase in length sharing from about 70% to 100% identity with at least a portion of the high risk HPV nucleic acid; b) comparing the sequence of the template nucleic acid with at least one low risk nucleic acid; and c) truncating the template nucleic acid by amplifying, the template nucleic acid with a deletion primer to remove any regions of the template nucleic acid that share from about 70% to 100% identity over 100 contiguous base pairs with a region of the low risk HPV nucleic acid.

8. The method of claim 7, wherein the template nucleic acid is methylated before the template nucleic acid is amplified.

9. The method of claim 8 wherein the methylated template nucleic acid is selectively digested.

10. A method for determining the presence of a target nucleic acid in a sample, the method comprising:
a) hybridizing at least one polynucleotide probe according to claim 1 to the target nucleic acid molecule to form a double-stranded nucleic acid hybrid;
b) capturing the double-stranded nucleic acid hybrid on a support, wherein the support comprises a first antibody specific for a double-stranded nucleic acid hybrid; and
c) detecting the target nucleic acid molecule.

11. The method of claim 10, wherein the double stranded nucleic acid hybrid is a DNA:RNA hybrid.

12. The method of claim 10 wherein the target nucleic acid is a high risk HPV nucleic acid.

13. The method of any of claim 10 wherein the sample is a biological sample.

* * * * *